United States Patent 7,745,391 (HUMAN THROMBOSPONDIN POLYPEPTIDE) - sequence listing, part 100

SEQ ID NO: 311190 - DNA, 882 bp, Homo sapiens
  misc_feature (814)..(814): n is a, c, g, or t
ggaagagaagctgagaggaactcctcactcagctagcttcaggagccatgacgtcatctctaccatggaaattccactcactctcctgtgcccccacatttgtcctaggcctcagagtccctataaagagagattcccaactcagtatcagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcagaatngcgtacgcgcgccagccgctccatccttccttctctttcccttctcatctttcactcgcatccattcc

SEQ ID NO: 311191 - DNA, 868 bp, Homo sapiens
ggaagagaagctgagaggaactcctcactcagctagcttcaggagccatgacgtcatctctaccatggaaattccactcactctcctgtgcccccacatttgtcctaggcctcagagtccctataaagagagattcccaactcagtatcagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggtattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcagtacgcgcgcagcgcccccccctcttttgtaattttctatttttcaagctaaattaccc

SEQ ID NO: 311192 - DNA, 748 bp, Homo sapiens
ggaagagaagctgagaggaactcctcactcagctagcttcaggagccatgacgtcatctctaccatggaaattccactcactctcctgtgcccccacatttgtcctaggcctcagagtccctataaagagagattcccaactcagtatcagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaatgggctcagaccctcccaccgcctgctgcttttcttacaccgcgaggaagcttcctcgcaactttgtggtagattactatgagaccagcagcctctgctcccagccagctgtggttacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgca

SEQ ID NO: 311193 - DNA, 1017 bp, Homo sapiens
ggaagagaagctgagaggaactcctcactcagctagcttcaggagccatgacgtcatctctaccatggaaattccactcactctcctgtgcccccacatttgtcctaggcctcagagtccctataaagagagattcccaactcagtatcagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaagtaagtctacttttgcagctgctatttcaagtcaaggtgtaggcagagtccttttttctagtcatggctggcaaacagtgggatctggggatgggacaaaaggcagctaggaagattgccatgtagtctgctgctaaatgtagagtctagtagatattcaataacattcaagttcctattttcttaagaattagcaaccagcagaggaaaacgatgggctggaagtcagactgttgaattggctctgcctttaattatttgttcaagcaagcccctgtccctctctgtgccttggtttccccatctgtcatatgaagggagtgcgatgtgttctgagactgaatccagttccaatcttctagatttctttctcgttcttctctgaagatccactattcaaaataagactcctgctcatgttaggtgggaatggatatttggggttctggtagctccacagggatgctcaatgaagatgcaaaattagaagtcaaaataaacagctcccacgggcagtgttgatctcaccctggcctttcctttcagtgggctcagaccctcccaccgcctgctgcttttcttacaccgcgaggaagcttcctcgcaactttgtggtagattactatgagaccagcagcctctgctcccagccagctgtggttgagtatcaacccctgggctgccctgggaggcaagggtgagggctggatttt

SEQ ID NO: 311194 - DNA, 694 bp, Homo sapiens
ggaagagaagctgagaggaactcctcactcagctagcttcaggagccatgacgtcatctctaccatggaaattccactcactctcctgtgcccccacatttgtcctaggcctcagagtccctataaagagagattcccaactcagtatcagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaaattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgca

SEQ ID NO: 311195 - DNA, 834 bp, Homo sapiens
ggaagagaagctgagaggaactcctcactcagctagcttcaggagccatgacgtcatctctaccatggaaattccactcactctcctgtgcccccacatttgtcctaggcctcagagtccctataaagagagattcccaactcagtatcagcacaggacacagctgggttctgaagcttctgagttctgcagcctcacctctgagaaaacctcttttccaccaataccatgaagctctgcgtgactgtcctgtctctcctcatgctagtagctgccttctgctctccagcgctctcagcaccaaattccaaaccaaaagaagcaagcaagtctgtgctgatcccagtgaatcctgggtccaggagtacgtgtatgacctggaactgaactgagctgctcagagacaggaagtcttcagggaaggtcacctgagcccggatgcttctccatgagacacatctcctccatactcaggactcctctccgcagttcctgtcccttctcttaatttaatcttttttatgtgccgtgttattgtattaggtgtcatttccattatttatattagtttagccaaaggataagtgtcccctatggggatggtccactgtcactgtttctctgctgttgcaaatacatggataacacatttgattctgtgtgttttcataataaaactttaaaataaaatgcaaaaattcttgactcaaccaccttatatatacgccctacttgggctcgctggccattccccctatgtaggcgaaacacaattattggccacctttttcaactgcgtcacttggtccctggagtacccattttcgcctgcct

SEQ ID NO: 311196 - DNA, 1909 bp, Homo sapiens
ggttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttgatcagattgatgaaaatctcaaactggctttgcaacaggacctgacctccatggcccctgggctggtcattcaagctgtgcgggtaacaaagcccaacataccagaggcaatccgcagaaactacgagttgatggaaagtgagaagacaaagcttctcattgccgcccagaaacagaaggtggtggaaaaggaagcagagacagagcggaagaaggcgctcattgaggcagaaaaagtggcccaggtggctgagatcacctacgggcagaaggtgatggagaaggagactgagaagaagatttcagaaattgaagatgctgcatttctggcccgggagaaggcaaaggcagatgctgagtgctacactgctatgaaaatagccgaagccaataagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaactcatttgatttcccttacttgggaaaatgcagtccagtgttctcacctctgcctccaaggtaggagatgtctgtgggtgaggctcagcaactgagcaaatatgtgcctgtgagtttgccagtagagctgtgaagaaacagctgcagagaacatttgaccttcctggcattcttgtctgcatgtgtgtgagttattttagaggtgtgctttcttgagccctcataaggaagtactggtgctaggttttgcaagattttgtatacactttgctccttgccctagggctcagagtggtggtttctgactacatttctagagtcagagcttgatcaccacaactcaattatttcggcatcttttcacctatgctgtgatttgttttttttttttcttctcaaaaattctgttcattggttccactcagcatcaagaagacagggacaaacaactcaagtgtcttaacagctgctggagtggg

SEQ ID NO: 311197 - DNA, 1477 bp, Homo sapiens
ggttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggactggaaaatgatttttcccaggaatcttcataaaagggaccctgagcaagaacatttttcatagcagacaggaggactcatccacatcgccagcaatcataattaagcaaaccgccttttgcaccatttaagatttaggaaatcatccaaattacttttaatgtttctgcagtagaaaatgaatctaaattcattttatagggtttgtagtcttttatctgttttggattcactgtgcttttaagaaaaagttggtaaatttgccgttgatttttctttttaacctcaaactaatagaattttataaaatattaattttctctagccattgtcttaggacttgtgacattacatgaacatttcaaagcactgaaaaaagacaaaggatccctaatgtccctgaagaggaaattaaaatacaaagttgtttttcattagcaaacttcttactttcttacagctaaacttggtagcttagtgaagtacagctgcttgtatggaggagctggggaaatatatttgctttgaaacttttttatttttacatctcagtcttgctagcaagcactacttggcttagaatctgtcatatccataaaggaggagctcatgtctctagtcctggcccttcaactcagaaggttcttctatactttccttctctcaggactcttatagcccagactttaaacatgaagctgcataattttcatcacttcttactctgccgcatcctctttgcccatgttattaaagtattatctaatactttgaagtttacctgaagaacctctttgtgtgtacttagtaatacaactttttttcctgtcccaacaccttttaatacagttgaatggataaaaacatggatacaaacacatggatatagttatcactgaagcagtgtgacataaaataatacctatgtatacaacactcctctgtaaatagcaaatgtaaagtaaaagatacacaacagaaa

SEQ ID NO: 311198 - DNA, 1088 bp, Homo sapiens
gggccccgccgaaggcaaaggcccactgtcagtcccccccgcgcacccccaagcgccaggcgatgagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaactcatttgatttcccttacttgggaaaatgcagtccagtgttctcacctctgcctccaaggtaggagatgtctgtgggtgaggctcagcaactgagcaaatatgtgcctgtgagtttgccagtagagctgtgaagaaacagctgcagagaacatttgaccttcctggcattcttgtctgcatgtgtgtgagttattttagaggtgtgctttcttgagccctcataaggaagtactggtgctaggttttgcaagattttgtatacactttgctccttgccctagggctcagagtggtggtttctgactacatttctagagtcagagcttgatcaccacaactcaattatttcggcatcttttcacctatgctgtgatttgttttttttttttcttctcaaaaattctgttcattggttccactcagcatcaagaagacagggacaaacaactcaagtgtcttaacagctgctggagtggg

SEQ ID NO: 311199 - DNA, 984 bp, Homo sapiens
ggttttcttgctcgtgggctcggacgagtacggagcgcctgcagggacagcctgaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttgatcagattgatgaaaatctcaaactggctttgcaacaggacctgacctccatggcccctgggctggtcattcaagctgtgcgggtaacaaagcccaacataccagaggcaatccgcagaaactacgagttgatgtgagtataccctccgcctgggctgtgaccaccactgcctcccacctcccacctcgtcccatcccagaggtaaccaaagctgccaggcttctcggttatccccttgctggaggatttgctacagcccattgcactgtaagattgggcaggcgtgtcagggccaccactggggctccctacctgtgattgagaaccccaggataatccctgtagagcagcgatgttttgaaaagggccagggggccttgtttgtgttcagtgactcatgcccaaggtggagacaggagcaagagaccagtaagtggacaggccggagacattgctttgacctccgggaggcagaagttgcacgtgagccccagatcatgtccatcccaatctaagcttgggcattgagacaggtccgctccagaaaaagcaagtctttccccaggattgccttggggagttccccttcaaatgacttcttgttcctccctc

SEQ ID NO: 311200 - DNA, 2042 bp, Homo sapiens
cttcaaagttgcccttctctgttctgactcctgggacttctggtcctgggcacactttttgcaggcaacaaaatgtgcctgggagtgatggattttaatgtgctccagagtcctttcagaaggtggtcatttcccttggccgggcgcggtggctcacacctgtaatcccagcactttgggaggccaaggcaggcggatcacctgaggttaggagttcgagaccaccctggccaacatgcgaaaccccatctctacgaaaaatagaaatattagccgggcatggtgtcaggcacctgtaatcccagctacttgggaggctgaggcaggagaattgcttgaactcgggaggcagaggttgcagtgagccaagatcatgccatcccactctagcttgggcaatagagcaaggctccgtctcaagaaaagaaggtcatttcccaagactagcatagggagtatccatttaaaatacattcatcttcctcccatttccgtgctattaatcacttgttagagcaacatgacatgcccagcatcccacttcccgaaaatgtctactccttctactctgagctcttgttgcctagacctcagaaaacaccaattcaccacagtagaaccgggagcagggatagctcagcttctctgaatagcacactttgctcaggtcttaacttgagggcctctccggtactaacatcctgcgatagcttgtcccatgagcacagaagagcctcagtagagtcaagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaagggagggttactgaaagaattttagcaatatattgattcaggaaaaggagctgttttataaatgatcattcactgttcctatggttctatgtatctttcaaaccgatacctttactatttaaagagcgtaaatagtgaaagtaagatggtcatacttactgactttatctatttaagtttgatggagataaactatatcttggctagtggctactgtgtctgtgaatgtaaccagtacttctttaagctctattcagtagggttccagccactgcttttttgttgtttctagccactgttttttttttcttgtttccttataaaacaggtaataaccaatcattttgtgtttgtatttccattcctttttatttctgcctttgtgtagactgatgattaagtaggcaaactacttctactttcaaagagccccaagggcttaatgaccccatttgtaactgagaaatgattcttgttttagtaatcattctataaatgatactgctggattgattgccgtgggttgatagctggaggaattgttttggacaatactaacatgtgaatttatgtcttagttttatttgcagtcttgctaagtaaaatgagtctttgtatctacttttttattaaagtgaaatttagcaatagttaatattaggtgacataaataaaacatcccagactagtgagttaagtacaagatctctctaaaaataaacagatgaaaatctatccccattatcgatacagaatttgtg

SEQ ID NO: 311201 - DNA, 1619 bp, Homo sapiens
cttcaaagttgcccttctctgttctgactcctgggacttctggtcctgggcacactttttgcaggcaacaaaatgtgcctgggagtgatggattttaatgtgctccagagtcctttcagaaggtggtcatttcccttggccgggcgcggtggctcacacctgtaatcccagcactttgggaggccaaggcaggcggatcacctgaggttaggagttcgagaccaccctggccaacatgcgaaaccccatctctacgaaaaatagaaatattagccgggcatggtgtcaggcacctgtaatcccagctacttgggaggctgaggcaggagaattgcttgaactcgggaggcagaggttgcagtgagccaagatcatgccatcccactctagcttgggcaatagagcaaggctccgtctcaagaaaagaaggtcatttcccaagactagcatagggagtatccatttaaaatacattcatcttcctcccatttccgtgctattaatcacttgttagagcaacatgacatgcccagcatcccacttcccgaaaatgtctactccttctactctgagctcttgttgcctagacctcagaaaacaccaattcaccacagtagaaccgggagcagggatagctcagcttctctgaatagcacactttgctcaggtcttaacttgagggcctctccggtactaacatcctgcgatagcttgtcccatgagcacagaagagcctcagtagagtcaagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaagggagggttactgaaagaattttagcaatatattgattcaggaaaaggagctgttttataaatgatcattcactgttcctatggttctatgtatctttcaaaccgatacctttactatttaaagagcgtaaatagtgaaagtaagatggtcatacttactgactttatctatttaagtttgatggagataaactatatcttggctagtggctactgtgtctgtgaatgtaaccagtacttctttaagctctattcagtagggttccagccactgcttttttgttgtttctagccactgttttttttttcttgtttccttataaaacaggtaataacca

SEQ ID NO: 311202 - DNA, 1822 bp, Homo sapiens
ggttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagcaatagagcaaggctccgtctcaagaaaagaaggtcatttcccaagactagcatagggagtatccatttaaaatacattcatcttcctcccatttccgtgctattaatcacttgttagagcaacatgacatgcccagcatcccacttcccgaaaatgtctactccttctactctgagctcttgttgcctagacctcagaaaacaccaattcaccacagtagaaccgggagcagggatagctcagcttctctgaatagcacactttgctcaggtcttaacttgagggcctctccggtactaacatcctgcgatagcttgtcccatgagcacagaagagcctcagtagagtcaagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaagggagggttactgaaagaattttagcaatatattgattcaggaaaaggagctgttttataaatgatcattcactgttcctatggttctatgtatctttcaaaccgatacctttactatttaaagagcgtaaatagtgaaagtaagatggtcatacttactgactttatctatttaagtttgatggagataaactatatcttggctagtggctactgtgtctgtgaatgtaaccagtacttctttaagctctattcagtagggttccagccactgcttttttgttgtttctagccactgttttttttttcttgtttccttataaaacaggtaataaccaatcattttgtgtttgtatttccattcctttttatttctgcctttgtgtagactgatgattaagtaggcaaactacttctactttcaaagagccccaagggcttaatgaccccatttgtaactgagaaatgattcttgttttagtaatcattctataaatgatactgctggattgattgccgtgggttgatagctggaggaattgttttggacaatactaacatgtgaatttatgtcttagttttatttgcagtcttgctaagtaaaatgagtctttgtatctacttttttattaaagtgaaatttagcaatagttaatattaggtgacataaataaaacatcccagactagtgagttaagtacaagatctctctaaaaataaacagatgaaaatctatccccattatcgatacagaatttgtg

SEQ ID NO: 311203 - DNA, 1914 bp, Homo sapiens
gggatagctcagcttctctgaatagcacactttgctcaggtcttaacttggagggcctctaccggtactaacatcctgcgatagtttgtcccatggcactggcaggaaaggacgcaactgcagatcggtagccggaggccgccacggataaaggctcactgatggctcagttgggagcagttgtggctgtggcttccagtttcttttgtgcatctctcttctcagctgtgcacaagatagaagagggacatattggggtatattacagcaatagagcaaggctccgtctcaagaaaagaaggtcatttcccaagactagcatagggagtatccatttaaaatacattcatcttcctcccatttccgtgctattaatcacttgttagagcaacatgacatgcccagcatcccacttcccgaaaatgtctactccttctactctgagctcttgttgcctagacctcagaaaacaccaattcaccacagtagaaccgggagcagggatagctcagcttctctgaatagcacactttgctcaggtcttaacttgagggcctctccggtactaacatcctgcgatagcttgtcccatgagcacagaagagcctcagtagagtcaagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaagggagggttactgaaagaattttagcaatatattgattcaggaaaaggagctgttttataaatgatcattcactgttcctatggttctatgtatctttcaaaccgatacctttactatttaaagagcgtaaatagtgaaagtaagatggtcatacttactgactttatctatttaagtttgatggagataaactatatcttggctagtggctactgtgtctgtgaatgtaaccagtacttctttaagctctattcagtagggttccagccactgcttttttgttgtttctagccactgttttttttttcttgtttccttataaaacaggtaataaccaatcattttgtgtttgtatttccattcctttttatttctgcctttgtgtagactgatgattaagtaggcaaactacttctactttcaaagagccccaagggcttaatgaccccatttgtaactgagaaatgattcttgttttagtaatcattctataaatgatactgctggattgattgccgtgggttgatagctggaggaattgttttggacaatactaacatgtgaatttatgtcttagttttatttgcagtcttgctaagtaaaatgagtctttgtatctacttttttattaaagtgaaatttagcaatagttaatattaggtgacataaataaaacatcccagactagtgagttaagtacaagatctctctaaaaataaacagatgaaaatctatccccattatcgatacagaatttgtg

SEQ ID NO: 311204 - DNA, 1151 bp, Homo sapiens
cttcaaagttgcccttctctgttctgactcctgggacttctggtcctgggcacactttttgcaggcaacaaaatgtgcctgggagtgatggattttaatgtgctccagagtcctttcagaaggtggtcatttcccttggccgggcgcggtggctcacacctgtaatcccagcactttgggaggccaaggcaggcggatcacctgaggttaggagttcgagaccaccctggccaacatgcgaaaccccatctctacgaaaaatagaaatattagccgggcatggtgtcaggcacctgtaatcccagctacttgggaggctgaggcaggagaattgcttgaactcgggaggcagaggttgcagtgagccaagatcatgccatcccactctagcttgggcaatagagcaaggctccgtctcaagaaaagaaggtcatttcccaagactagcatagggagtatccatttaaaatacattcatcttcctcccatttccgtgctattaatcacttgttagagcaacatgacatgcccagcatcccacttcccgaaaatgtctactccttctactctgagctcttgttgcctagacctcagaaaacaccaattcaccacagtagaaccgggagcagggatagctcagcttctctgaatagcacactttgctcaggtcttaacttgagggcctctccggtactaacatcctgcgatagcttgtcccatgagcacagaagagcctcagtagagtcaagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtga

SEQ ID NO: 311205 - DNA, 1988 bp, Homo sapiens
cttcaaagttgcccttctctgttctgactcctgggacttctggtcctgggcacactttttgcaggcaacaaaatgtgcctgggagtgatggattttaatgtgctccagagtcctttcagaaggtggtcatttcccttggccgggcgcggtggctcacacctgtaatcccagcactttgggaggccaaggcaggcggatcacctgaggttaggagttcgagaccaccctggccaacatgcgaaaccccatctctacgaaaaatagaaatattagccgggcatggtgtcaggcacctgtaatcccagctacttgggaggctgaggcaggagaattgcttgaactcgggaggcagaggttgcagtgagccaagatcatgccatcccactctagcttgggcaatagagcaaggctccgtctcaagaaaagaaggtcatttcccaagactagcatagggagtatccatttaaaatacattcatcttcctcccatttccgtgctattaatcacttgttagagcaacatgacatgcccagcatcccacttcccgaaaatgtctactccttctactctgagctcttgttgcctagacctctgaatagcacactttgctcaggtcttaacttgagggcctctccggtactaacatcctgcgatagcttgtcccatgagcacagaagagcctcagtagagtcaagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaagggagggttactgaaagaattttagcaatatattgattcaggaaaaggagctgttttataaatgatcattcactgttcctatggttctatgtatctttcaaaccgatacctttactatttaaagagcgtaaatagtgaaagtaagatggtcatacttactgactttatctatttaagtttgatggagataaactatatcttggctagtggctactgtgtctgtgaatgtaaccagtacttctttaagctctattcagtagggttccagccactgcttttttgttgtttctagccactgttttttttttcttgtttccttataaaacaggtaataaccaatcattttgtgtttgtatttccattcctttttatttctgcctttgtgtagactgatgattaagtaggcaaactacttctactttcaaagagccccaagggcttaatgaccccatttgtaactgagaaatgattcttgttttagtaatcattctataaatgatactgctggattgattgccgtgggttgatagctggaggaattgttttggacaatactaacatgtgaatttatgtcttagttttatttgcagtcttgctaagtaaaatgagtctttgtatctacttttttattaaagtgaaatttagcaatagttaatattaggtgacataaataaaacatcccagactagtgagttaagtacaagatctctctaaaaataaacagatgaaaatctatccccattatcgatacagaatttgtg

SEQ ID NO: 311206 - DNA, 2238 bp, Homo sapiens
ggttttcttgctcgtgggctcggacgagtacggagcgcctgcagggacagcctggtacgcggcccccgccccttcgtgcgcgcgctgggcctagctgccgctcagggtcggggctgacccgtcactttcgggaacctcagtcccagcagcttctctccctcagccggcccgctcctggagagagacagaaacccttttctgtcgcgtcctctccttgcgagccgcagggggaccgagcggaggctattggagccgcagccccagaccagggcgcttgaccctctctcggaacggggcggggaaggggcgcgagtgacctcggggagggaagggcactggcaggaaaggacgcaactgcagatcggtagccggaggccgccacggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttgatcagattgatgaaaatctcaaactggctttgcaacaggacctgacctccatggcccctgggctggtcattcaagctgtgcgggtaacaaagcccaacataccagaggcaatccgcagaaactacgagttgatggaaagtgagaagacaaagcttctcattgccgcccagaaacagaaggtggtggaaaaggaagcagagacagagcggaagaaggcgctcattgaggcagaaaaagtggcccaggtggctgagatcacctacgggcagaaggtgatggagaaggagactgagaagaagatttcagaaattgaagatgctgcatttctggcccgggagaaggcaaaggcagatgctgagtgctacactgctatgaaaatagccgaagccaataagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaactcatttgatttcccttacttgggaaaatgcagtccagtgttctcacctctgcctccaaggtaggagatgtctgtgggtgaggctcagcaactgagcaaatatgtgcctgtgagtttgccagtagagctgtgaagaaacagctgcagagaacatttgaccttcctggcattcttgtctgcatgtgtgtgagttattttagaggtgtgctttcttgagccctcataaggaagtactggtgctaggttttgcaagattttgtatacactttgctccttgccctagggctcagagtggtggtttctgactacatttctagagtcagagcttgatcaccacaactcaattatttcggcatcttttcacctatgctgtgatttgttttttttttttcttctcaaaaattctgttcattggttccactcagcatcaagaagacagggacaaacaactcaagtgtcttaacagctgctggagtggg

SEQ ID NO: 311207 - DNA, 2349 bp, Homo sapiens
ggttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggtaagaaagtctctcctgagcatgccgtgcttaagcagggttcctggaaccccgcgtctctccactgcctaaagcctggctgcctgcagggtgtgatggtcacttatggacaggaaatgttaaagaatcttgtgctcaggagctggtcacaaaggagttcatggagaatgctgatagctatgcaacaagatccttagagggctggagctttgggcacagggaccatagtggagtagagtattcacttctggcctcaatcagaggctggagtggaaatgtgttcccactgttcctaaactatcattctataatgaagacaaggtccattctagaagaaccttagagattgtccagaccagcatcctcattttaagctgagggtactgtgacccaaagcaagaaagtcacagagccagatgccaattagtagtggggctgaaacaggagccttcctctcctggctcttcagcattcttctcaccatgcaacactgaatggagggcccccaggaatgggtgatgaaaaagacatgattcatagttaattctagaagtgagatgagaaccatagctccttccagttctcagaacctttgtgattattatttttttactctgtacctgtagcaacgaatagaaaaacactttaaacaaaaagattccacgtgcctaagtagatatgttttgtcctttttacctttttcaaagtaaaggcaacctgacttagcagcaaaggaaggacacagttgggtaactgttataacttgtttgcagtcaagtattctgtttaaactcactgccagaaattctctaatagccaatgccaaaagtaaatgaatttttaaccaatagtataactgttcttgacactaggactggaaaatgatttttcccaggaatcttcataaaagggaccctgagcaagaacatttttcatagcagacaggaggactcatccacatcgccagcaatcataattaagcaaaccgccttttgcaccatttaagatttaggaaatcatccaaattacttttaatgtttctgcagtagaaaatgaatctaaattcattttatagggtttgtagtcttttatctgttttggattcactgtgcttttaagaaaaagttggtaaatttgccgttgatttttctttttaacctcaaactaatagaattttataaaatattaattttctctagccattgtcttaggacttgtgacattacatgaacatttcaaagcactgaaaaaagacaaaggatccctaatgtccctgaagaggaaattaaaatacaaagttgtttttcattagcaaacttcttactttcttacagctaaacttggtagcttagtgaagtacagctgcttgtatggaggagctggggaaatatatttgctttgaaacttttttatttttacatctcagtcttgctagcaagcactacttggcttagaatctgtcatatccataaaggaggagctcatgtctctagtcctggcccttcaactcagaaggttcttctatactttccttctctcaggactcttatagcccagactttaaacatgaagctgcataattttcatcacttcttactctgccgcatcctctttgcccatgttattaaagtattatctaatactttgaagtttacctgaagaacctctttgtgtgtacttagtaatacaactttttttcctgtcccaacaccttttaatacagttgaatggataaaaacatggatacaaacacatggatatagttatcactgaagcagtgtgacataaaataatacctatgtatacaacactcctctgtaaatagcaaatgtaaagtaaaagatacacaacagaaa

SEQ ID NO: 311208 - DNA, 2678 bp, Homo sapiens
ggttttcttgctcgtgggctcggacgagtacggagcgcctgcagggacagcctggtacgcggcccccgccccttcgtgcgcgcgctgggcctagctgccgctcagggtcggggctgacccgtcactttcgggaacctcagtcccagcagcttctctccctcagccggcccgctcctggagagagacagaaacccttttctgtcgcgtcctctccttgcgagccgcagggggaccgagcggaggctattggagccgcagccccagaccagggcgcttgaccctctctcggaacggggcggggaaggggcgcgagtgacctcggggagggaagggcactggcaggaaaggacgcaactgcagatcggtagccggaggccgccacggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggtaagaaagtctctcctgagcatgccgtgcttaagcagggttcctggaaccccgcgtctctccactgcctaaagcctggctgcctgcagggtgtgatggtcacttatggacaggaaatgttaaagaatcttgtgctcaggagctggtcacaaaggagttcatggagaatgctgatagctatgcaacaagatccttagagggctggagctttgggcacagggaccatagtggagtagagtattcacttctggcctcaatcagaggctggagtggaaatgtgttcccactgttcctaaactatcattctataatgaagacaaggtccattctagaagaaccttagagattgtccagaccagcatcctcattttaagctgagggtactgtgacccaaagcaagaaagtcacagagccagatgccaattagtagtggggctgaaacaggagccttcctctcctggctcttcagcattcttctcaccatgcaacactgaatggagggcccccaggaatgggtgatgaaaaagacatgattcatagttaattctagaagtgagatgagaaccatagctccttccagttctcagaacctttgtgattattatttttttactctgtacctgtagcaacgaatagaaaaacactttaaacaaaaagattccacgtgcctaagtagatatgttttgtcctttttacctttttcaaagtaaaggcaacctgacttagcagcaaaggaaggacacagttgggtaactgttataacttgtttgcagtcaagtattctgtttaaactcactgccagaaattctctaatagccaatgccaaaagtaaatgaatttttaaccaatagtataactgttcttgacactaggactggaaaatgatttttcccaggaatcttcataaaagggaccctgagcaagaacatttttcatagcagacaggaggactcatccacatcgccagcaatcataattaagcaaaccgccttttgcaccatttaagatttaggaaatcatccaaattacttttaatgtttctgcagtagaaaatgaatctaaattcattttatagggtttgtagtcttttatctgttttggattcactgtgcttttaagaaaaagttggtaaatttgccgttgatttttctttttaacctcaaactaatagaattttataaaatattaattttctctagccattgtcttaggacttgtgacattacatgaacatttcaaagcactgaaaaaagacaaaggatccctaatgtccctgaagaggaaattaaaatacaaagttgtttttcattagcaaacttcttactttcttacagctaaacttggtagcttagtgaagtacagctgcttgtatggaggagctggggaaatatatttgctttgaaacttttttatttttacatctcagtcttgctagcaagcactacttggcttagaatctgtcatatccataaaggaggagctcatgtctctagtcctggcccttcaactcagaaggttcttctatactttccttctctcaggactcttatagcccagactttaaacatgaagctgcataattttcatcacttcttactctgccgcatcctctttgcccatgttattaaagtattatctaatactttgaagtttacctgaagaacctctttgtgtgtacttagtaatacaactttttttcctgtcccaacaccttttaatacagttgaatggataaaaacatggatacaaacacatggatatagttatcactgaagcagtgtgacataaaataatacctatgtatacaacactcctctgtaaatagcaaatgtaaagtaaaagatacacaacagaaa

SEQ ID NO: 311209 - DNA, 2302 bp, Homo sapiens
ggttttcttgctcgtgggctcggacgagtacggagcgcctgcagggacagcctggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggtaagaaagtctctcctgagcatgccgtgcttaagcagggttcctggaaccccgcgtctctccactgcctaaagcctggctgcctgcagggtgtgatggtcacttatggacaggaaatgttaaagaatcttgtgctcaggagctggtcacaaaggagttcatggagaatgctgatagctatgcaacaagatccttagagggctggagctttgggcacagggaccatagtggagtagagtattcacttctggcctcaatcagaggctggagtggaaatgtgttcccactgttcctaaactatcattctataatgaagacaaggtccattctagaagaaccttagagattgtccagaccagcatcctcattttaagctgagggtactgtgacccaaagcaagaaagtcacagagccagatgccaattagtagtggggctgaaacaggagccttcctctcctggctcttcagcattcttctcaccatgcaacactgaatggagggcccccaggaatgggtgatgaaaaagacatgattcatagttaattctagaagtgagatgagaaccatagctccttccagttctcagaacctttgtgattattatttttttactctgtacctgtagcaacgaatagaaaaacactttaaacaaaaagattccacgtgcctaagtagatatgttttgtcctttttacctttttcaaagtaaaggcaacctgacttagcagcaaaggaaggacacagttgggtaactgttataacttgtttgcagtcaagtattctgtttaaactcactgccagaaattctctaatagccaatgccaaaagtaaatgaatttttaaccaatagtataactgttcttgacactaggactggaaaatgatttttcccaggaatcttcataaaagggaccctgagcaagaacatttttcatagcagacaggaggactcatccacatcgccagcaatcataattaagcaaaccgccttttgcaccatttaagatttaggaaatcatccaaattacttttaatgtttctgcagtagaaaatgaatctaaattcattttatagggtttgtagtcttttatctgttttggattcactgtgcttttaagaaaaagttggtaaatttgccgttgatttttctttttaacctcaaactaatagaattttataaaatattaattttctctagccattgtcttaggacttgtgacattacatgaacatttcaaagcactgaaaaaagacaaaggatccctaatgtccctgaagaggaaattaaaatacaaagttgtttttcattagcaaacttcttactttcttacagctaaacttggtagcttagtgaagtacagctgcttgtatggaggagctggggaaatatatttgctttgaaacttttttatttttacatctcagtcttgctagcaagcactacttggcttagaatctgtcatatccataaaggaggagctcatgtctctagtcctggcccttcaactcagaaggttcttctatactttccttctctcaggactcttatagcccagactttaaacatgaagctgcataattttcatcacttcttactctgccgcatcctctttgcccatgttattaaagtattatctaatactttgaagtttacctgaagaacctctttgtgtgtacttagtaatacaactttttttcctgtcccaacaccttttaatacagttgaatggataaaaacatggatacaaacacatggatatagttatcactgaagcagtgtgacataaaataatacctatgtatacaacactcctctgtaaatagcaaatgtaaagtaaaagatacacaacagaaa

SEQ ID NO: 311210 - DNA, 743 bp, Homo sapiens
ggttttcttgctcgtgggctcggacgagtacggagcgcctgcagggacagcctggtacgcggcccccgccccttcgtgcgcgcgctgggcctagctgccgctcagggtcggggctgacccgtcactttcgggaacctcagtcccagcagcttctctccctcagccggcccgctcctggagagagacagaaacccttttctgtcgcgtcctctccttgcgagccgcagggggaccgagcggaggctattggagccgcagccccagaccagggcgcttgaccctctctcggaacggggcggggaaggggcgcgagtgacctcggggagggaagggcactggcaggaaaggacgcaactgcagatcggtagccggaggccgccacggataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcaggtatgtgttatagggtttggtactctccccggtttcaagcatccactgggggccttcgaacataaagcggtgcctaacataaatagaagaggtagaagcaagcacaagtcttaagatgcccaatccagtgtcatcttcactaaaccattattactc

SEQ ID NO: 311211 - DNA, 273 bp, Homo sapiens
tcacactgatggaaggggactgtgctcactggcatatcccactctgcccttgtgtgcactcacagctgccctctgggggctctccagacaagctggcccaccaggacactcagctcgggtgaaaggtgaaattagtcaaactctgaaatgccagaaccgtaatcctcactatcatttattcagaggcagaaaaagtggcccaggtggctgagatcacctacgggcagaaggtgatggagaaggagactgagaagaagatttcagaaattgaag

SEQ ID NO: 311212 - DNA, 2548 bp, Homo sapiens
gggatagctcagcttctctgaatagcacactttgctcaggtcttaacttggagggcctctaccggtactaacatcctgcgatagtttgtcccatggcactggcaggaaaggacgcaactgcagatcggtagccggaggccgccacggtaaaataagcgcctcgcagatgtccgcgccccggttacgttagacctgggaggcagaatccacgccctgcgctcacgggcccacgcacgcacagctgaactttgcagataaaggctcactgatggctcagttgggagcagttgtggctgtggcttccagtttcttttgtgcatctctcttctcagctgtgcacaagatagaagagggacatattggggtatattacagaggcggtgccctgctgacttcgaccagcggccctggtttccatctcatgctccctttcatcacatcatataagtctgtgcagaccacactccagacagatgaggtgaagaatgtaccttgtgggactagtggtggtgtgatgatctactttgacagaattgaagtggtgaacttcctggtcccgaacgcagtgtatgatatagtgaagaactatactgctgactatgacaaggccctcatcttcaacaagatccaccacgaactgaaccagttctgcagtgtgcacacgcttcaagaggtctacattgagctgtttggtaagaaagtctctcctgagcatgccgtgcttaagcagggttcctggaaccccgcgtctctccactgcctaaagcctggctgcctgcagggtgtgatggtcacttatggacaggaaatgttaaagaatcttgtgctcaggagctggtcacaaaggagttcatggagaatgctgatagctatgcaacaagatccttagagggctggagctttgggcacagggaccatagtggagtagagtattcacttctggcctcaatcagaggctggagtggaaatgtgttcccactgttcctaaactatcattctataatgaagacaaggtccattctagaagaaccttagagattgtccagaccagcatcctcattttaagctgagggtactgtgacccaaagcaagaaagtcacagagccagatgccaattagtagtggggctgaaacaggagccttcctctcctggctcttcagcattcttctcaccatgcaacactgaatggagggcccccaggaatgggtgatgaaaaagacatgattcatagttaattctagaagtgagatgagaaccatagctccttccagttctcagaacctttgtgattattatttttttactctgtacctgtagcaacgaatagaaaaacactttaaacaaaaagattccacgtgcctaagtagatatgttttgtcctttttacctttttcaaagtaaaggcaacctgacttagcagcaaaggaaggacacagttgggtaactgttataacttgtttgcagtcaagtattctgtttaaactcactgccagaaattctctaatagccaatgccaaaagtaaatgaatttttaaccaatagtataactgttcttgacactaggactggaaaatgatttttcccaggaatcttcataaaagggaccctgagcaagaacatttttcatagcagacaggaggactcatccacatcgccagcaatcataattaagcaaaccgccttttgcaccatttaagatttaggaaatcatccaaattacttttaatgtttctgcagtagaaaatgaatctaaattcattttatagggtttgtagtcttttatctgttttggattcactgtgcttttaagaaaaagttggtaaatttgccgttgatttttctttttaacctcaaactaatagaattttataaaatattaattttctctagccattgtcttaggacttgtgacattacatgaacatttcaaagcactgaaaaaagacaaaggatccctaatgtccctgaagaggaaattaaaatacaaagttgtttttcattagcaaacttcttactttcttacagctaaacttggtagcttagtgaagtacagctgcttgtatggaggagctggggaaatatatttgctttgaaacttttttatttttacatctcagtcttgctagcaagcactacttggcttagaatctgtcatatccataaaggaggagctcatgtctctagtcctggcccttcaactcagaaggttcttctatactttccttctctcaggactcttatagcccagactttaaacatgaagctgcataattttcatcacttcttactctgccgcatcctctttgcccatgttattaaagtattatctaatactttgaagtttacctgaagaacctctttgtgtgtacttagtaatacaactttttttcctgtcccaacaccttttaatacagttgaatggataaaaacatggatacaaacacatggatatagttatcactgaagcagtgtgacataaaataatacctatgtatacaacactcctctgtaaatagcaaatgtaaagtaaaagatacacaacagaaa

SEQ ID NO: 311213 - DNA, 3010 bp, Homo sapiens
attcggaagaaggcggagcctacctctcatcaggaccagtctgactgcacctgcatccttagctcagagcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcacaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccacgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcccatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgcttcataaaacaggggccctcagaagttctccttaaatttttcaataaaaatttagctctta

SEQ ID NO: 311214 - DNA, 5247 bp, Homo sapiens
attcggaagaaggcggagcctacctctcatcaggaccagtctgactgcacctgcatccttagctcagagcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcacaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccacgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcccatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgcttcataaaacaggggccctcagaagttctccttaaatttttcaataaaaatttagctcttaaaaaaataacagtgtgactgagtgaatgaagataagttggattctttcagagcattcttttcctcaaaacgagctgcataattcttggaatttatgtcttaccacatggtggagggatggaggaactacaggatgcaattcttcttctaccaatgggcaatagaggttgagagagattcagcatctttctgggattagaattcaagtctctttactcctacagcagctgtgtctccaacgttgagactttgcagatggcacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggca

SEQ ID NO: 311215 - DNA, 5356 bp, Homo sapiens
attcggaagaaggcggagcctacctctcatcaggaccagtctgactgcacctgcatccttagctcagagcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcacaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccacgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcccatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgcttcataaaacaggggccctcagaagttctccttaaatttttcaataaaaatttagctcttaaaaaaataacagtgtgactgagtgaatgaagataagttggattctttcagagcattcttttcctcaaaacgagctgcataattcttggaatttatgtcttaccacatggtggagggatggaggaactacaggatgcaattcttcttctaccaatgggcaatagaggttgagagagattcagcatctttctgggattagaattcaagtctctttactcctacagcagctgtgtctccaacgttgagactttgcagatggcacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggcaaaaaaaaaacacaacaatcaaaacaaacacaaaatcaacaacaatcacaaacccacatacaacaacatacacaaaccatcacactatcatataaccaccactctacacc

SEQ ID NO: 311216 - DNA, 5095 bp, Homo sapiens
attcggaagaaggcggagcctacctctcatcaggaccagtctgactgcacctgcatccttagctcagagcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcacaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccacgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcccatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgcttcataaaacaggggccctcagaagttctccttaaatttttcaataaaaatttagctcttaaaaaaataacagtgtgactgagtgaatgaagataagttggattctttcagagcattcttttcctcaaaacgagctgcataattcttggaatttatgtcttaccacatggtggagggatggaggaactacaggatgcaattcttcttctaccaatgggcaatagaggttgagagagattcagcatctttctgggattagaattcaagtctctttactcctacagcagctgtgtctccaacgttgagactttgcagatggcacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttga

SEQ ID NO: 311217 - DNA, 5099 bp, Homo sapiens
attcggaagaaggcggagcctacctctcatcaggaccagtctgactgcacctgcatccttagctcagagcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcacaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccacgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcccatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgcttcataaaacaggggccctcagaagttctccttaaatttttcaataaaaatttagctcttaaaaaaataacagtgtgactgagtgaatgaagataagttggattctttcagagcattcttttcctcaaaacgagctgcataattcttggaatttatgtcttaccacatggtggagggatggaggaactacaggatgcaattcttcttctaccaatgggcaatagaggttgagagagattcagcatctttctgggattagaattcaagtctctttactcctacagcagctgtgtctccaacgttgagactttgcagatggcacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggca

SEQ ID NO: 311218 - DNA, 3688 bp, Homo sapiens
attcggaagaaggcggagcctacctctcatcaggaccagtctgactgcacctgcatccttagctcagagcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcacaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccacgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagcagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggca

SEQ ID NO: 311219 - DNA, 2106 bp, Homo sapiens
attcggaagaaggcggagcctacctctcatcaggaccagtctgactgcacctgcatccttagctcagagcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggca

SEQ ID NO: 311220 - DNA, 2548 bp, Homo sapiens
attcggaagaaggcggagcctacctctcatcaggaccagtctgactgcacctgcatccttagctcagagcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcacaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccacgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttatcagttcttagcatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggat

SEQ ID NO: 311221 - DNA, 4210 bp, Homo sapiens
agcgggtgccgtgtccggacgcagcggcagctccccggggagaagggcgacgtgaccaggcacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcccatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgcttcataaaacaggggccctcagaagttctccttaaatttttcaataaaaatttagctcttaaaaaaataacagtgtgactgagtgaatgaagataagttggattctttcagagcattcttttcctcaaaacgagctgcataattcttggaatttatgtcttaccacatggtggagggatggaggaactacaggatgcaattcttcttctaccaatgggcaatagaggttgagagagattcagcatctttctgggattagaattcaagtctctttactcctacagcagctgtgtctccaacgttgagactttgcagatggcacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggca

SEQ ID NO: 311222 - DNA, 5111 bp, Homo sapiens
attcggaagaaggcggagcctacctctcatcaggaccagtctgactgcacctgcatccttagctcagagcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcacaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccacgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcccatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgcttcataaaacaggggccctcagaagttctccttaaatttttcaataaaaatttagctcttaaaaaaataacagtgtgactgagtgaatgaagataagttggattctttcagagcattcttttcctcaaaacgagctgcataattcttggaatttatgtcttaccacatggtggagggatggaggaactacaggatgcaattcttcttctaccaatgggcaatagaggttgagagagattcagcatctttctgggattagaattcaagtctctttactcctacagcagctgtgtctccaacgttgagactttgcagatggcacagactccatggataataggtaaacttggggccgggcgcagtggctcacgcctgtaatcccagtattttgggaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggca

SEQ ID NO: 311223 - DNA, 3908 bp, Homo sapiens
attcggaagaaggcggagcctacctctcatcaggaccagtctgactgcacctgcatccttagctcagagcatccccggagcatcttaagagctgagcgcagctgacaactaggggccggaccgtcgcaggaggcgtccgctggataccttcccccttccctgacctagagctctacagctgctgcctcggtactgaccgagggttcccagagctgtctcaccattgcaaaaacgttatagcaacagcctctgattacgacatggctgagatcaccaatatccgacctagctttgatgtgtcaccggtggtggccggcctcatcggggcctctgtgctggtggtgtgtgtctcggtgaccgtctttgtctggtcatgctgccaccagcaggcagagaagaagcacaagaacccaccatacaagtttattcacatgctcaaaggcatcagcatatacccagagaccctcagcaacaagaagaaaatcatcaaagtgcggagagacaaagatggtcctgggagggaaggtggacgtaggaacctgttggtggacgcagcagaggctggcctgctaagccgagacaaagatcccagggggcctagctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccacgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccagaagtgcatcagcagaggggagctccaggtgtctctgtcatatcagcctgtggcacagagaatgacagtggtggtcctcaaagccagacacttgccgaagatggatatcaccggtctctcaggtaatccttatgtcaaggtgaacgtctactacggcagaaagcgcattgccaagaagaaaacccatgtgaagaagtgcactttgaaccccatcttcaatgaatctttcatctacgacatccccactgacctcctgcctgatatcagcatcgagttcctcgttatcgacttcgatcgcaccaccaagaatgaggtggtggggaggctgatcctgggggcacacagtgtcacagccagtggtgctgaacactggagagaggtctgcgagagcccccgcaagcctgtggccaagtggcacagtctgagcgagtactaatcctgttcttctctcctctaatccccgggggccaagctggggagggatgtggaggggaaaaagatgacagagaagtggactccaaacctcattttagttgtagaagaaaatttcttacaaaacaaattccacaaagaacaccctatatgaccacagctgcagatcagttcttagcaatgatgtttttttttctgctttgcaaggcgctagaatcttttattttactttattttttttgaggtggagtttcgctcttgttgcccgggctggagtgcaatggtgagatctcaactcactgcaacctctgccctccaggttcaagtgattctcctccctcagcctcccaagtagctgggattacaggcacccacgagcatgcccggctaattttttgtattttcagtagagatgggtttcaccatgttggccaggctggtctcgaattccaggccgaggtggaaagatcgcttgagcccaggagttcaagaccagcctgggctacatgacgaaactccatctctatcaaaaatacaaaaaattaactaggtgtggtgctgcacgcctgtggtcccagctattcaggaggctgaggtgggaggatcatttgagcccagaggtagaggctgcagtgagccatgatcatgccactgcactctgggctgggtaacagagtgagatcctgtctcaaaaattaattaattaattaattaaaataaactaggtaaacttggataggcagtagatatttttgcccacctgaggaggaactcagtcaagctgttgcttaacagcttgatccagggcgtgaaaggttagttgagactgaagtgttcacttccatagaagaacatcacttttaaccttgctttggcgaagggagtcggaaagctgagtctctatggacgggggggtgatcttgctttcagtgttccctcagcttttgtggatttaaaaccattctgctccccctaaaccttttgtttgatttcagcccatgttcttgacaatgcagagcaattctgagcagtcacaaagcctactctctgttcttgtccctgccaacccccaccccccataatctgactcacaacttcaccatcagttggggtcataccactagtctctgtcctataccccatgaaatgtaaatactgtatcataagtagaagaaaataatttttgttttctaaaaatgcattttgagatagtttaatgtaaatctgacaggagcattctgaagccccattaggaaaaaatttaaatggttcctcttcatcgccttaatgtctaaagatcagaaatcgctgagcaaacccgcttttgtttccttcccagaaacaatgcaaaacaacaggtggagatagtctggtctttgccctgctgtgtgtgcctctgtagctcctcctgacaaacgtctgggaaaacagcctcaccccactctcctctctcttccccatttccttgtagctttattccttgcatctttgggtctactgagcagtgggtgctgaggtgacaggggaggaaccagttgttctgtagcctaggaactgcctcagtgtctttgccagaaaaaggcaaagaggcggacagtgcagggctcctccctcctacctcaggcctgatccatcgtgcccttgactttgccgtctcaaagtttcttagctgactttggctttcacatttgttctttccagagctaactgataagagtggaggaggaatgccttctcctaagagtcagttgaaagaaagacaagagagtcacatcttagcttttgcacaaggcattcgtggtcaggaataggttagggaatggtcacttctgattttccaacagttgctccttctctgaagagatcttgattcctttgggaagacaagaatttttcttaataacaaaggtccctttatgagttattccttctttcagttcatctcactggagcacagccaagatggacatgtttatggacagtgctctagatgtgaaaacagatagaactggtttgtgggacaggggcagcttgctcaggagagggaataacgcaggtcccttttcttggaaggcttgtactatggccatgacagtgacattgccctcaccatgatccctctccaaagtggttgtctttctttaccttgtgtcttctcttgtaaaaatgaaactcaaaaataaaataaatgtgtcaaattttgaaaaaaaaagaaaactgaaaaagctaacatgaattgtgtgaaattgcataatgctgtaatgctaatctacaatatgtaatgctatcttgtatgttgaatttgttaatgcaccacacaagtgcaaaataaagactgattcacattacataggca

SEQ ID NO: 311224 - DNA, 1147 bp, Homo sapiens
gcagagacagcagccagaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatgtgagttcagcacaccaaccttccctggcctgaagttcttccttgtggagcaagggacaagcctcataaacctagagtcagagagtgcactatttaacttaatgtacaaaggttcccaatgggaaaactgaggcaccaagggaaaaagtgaaccccaacatcactctccacctgggtgcctattcagaacaccccaatttctttagcttgaagtcaggatggctccacctggacacctataggagcagtttgccctgggttccctccttccacctgcgttcctcctctagctcccatggcagccctttggtgcagaatgggctgcacttctagaccaaaactgcaaaggaacttcatctaactctgtcctccctccccacagcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaa

SEQ ID NO: 311225 - DNA, 746 bp, Homo sapiens
  misc_feature (628)..(628): n is a, c, g, or t
gcagagacagcagccagaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccaggtaaggccccctcttcttctccttgaaccacattgtcttctctctgagttatcatggaccatccaagcagacgtggtacccacagtcttgctttaacgctacttttccaagataaggtgactcagaaaaggacaaggggtgagcccaaccacacagctgctgctcggcagagcctgaactagaattccagctgtgaaccccaaatccagctccttccaggattccagctctgggaacacactcagcgcagttactcccccagctgcttccagcagagtttggggatcagggtaatcaaagagagggtgggtgtgtaggctgtttccagacacgctggagacccagaatctggtctgtgcttcattcaccttagcttccagagacggtgactctgcagaggtaatgagtatcagggaaactcatgaccaggcatagcctattcagagtctatggttcgcctaangacccttgagcatatctagcttaactctgtcattatcatggtattacccattttacgcataggctgagtcatgggtccgacaccatctagttttgaggtaggcagagcaccgggattt

SEQ ID NO: 311226 - DNA, 829 bp, Homo sapiens
gcagagacagcagccagaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaaaaaaaatattaaattatgcggcccgcaattcgagctcaacttgcccttggccctataggggtcg

SEQ ID NO: 311227 - DNA, 692 bp, Homo sapiens
  misc_feature (574)..(574): n is a, c, g, or t
gcagagacagcagccagaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccaggtaaggccccctcttcttctccttgaaccacattgtcttctctctgagttatcatggaccatccaagcagacgtggtacccacagtcttgctttaacgctacttttccaagataaggtgactcagtagaattccagctgtgaaccccaaatccagctccttccaggattccagctctgggaacacactcagcgcagttactcccccagctgcttccagcagagtttggggatcagggtaatcaaagagagggtgggtgtgtaggctgtttccagacacgctggagacccagaatctggtctgtgcttcattcaccttagcttccagagacggtgactctgcagaggtaatgagtatcagggaaactcatgaccaggcatagcctattcagagtctatggttcgcctaangacccttgagcatatctagcttaactctgtcattatcatggtattacccattttacgcataggctgagtcatgggtccgacaccatctagttttgaggtaggcagagcaccgggattt

SEQ ID NO: 311228 - DNA, 686 bp, Homo sapiens
  misc_feature (40)..(40): n is a, c, g, or t
  misc_feature (51)..(51): n is a, c, g, or t
  misc_feature (57)..(57): n is a, c, g, or t
  misc_feature (60)..(60): n is a, c, g, or t
  misc_feature (75)..(76): n is a, c, g, or t
  misc_feature (89)..(89): n is a, c, g, or t
  misc_feature (107)..(107): n is a, c, g, or t
  misc_feature (120)..(120): n is a, c, g, or t
tcaatccttcccctggcggtaataattctattgcgcaagntttcaatttcnatcgcntancttaatctgggtaannggtttggctaagntgtctggtagtaaggtgnagtggctcgtgcngattcggcacgagaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaa

SEQ ID NO: 311229 - DNA, 758 bp, Homo sapiens
gcagagacagcagccagaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccatggcttcgctactctcatcgcggaatcgaatatttgcacctttcccccaatattcattttttgtccacc

SEQ ID NO: 311230 - DNA, 1197 bp, Homo sapiens
  misc_feature (780)..(780): n is a, c, g, or t
gcagagacagcagccagaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaaaaaaaaaaaaaaagngggggggggaaaaaaaatacccccgggggggcccaagttaaacgggaccccggttttttggtaaaaggggggccccataagggaggaggaaaaaaaagaaaggaaggggcccgccggttaacaacgctcgggcaggggaaacgcgcaccggggccacccgcaggagaggagaccccaacttcgggcgcgggccatatggggacacccccccacagagaatagggcccgggcaaacacaacttcacggtggacggggtcacccacggatagctggggggaaagttgccacggaatgctatcagaataagcggccgagcatagacaaacgccacacaaaccagacaaacaccaaataaagcaaacaacacgaaaagaagaaaaccaagaaaaaaacaaagaaaacctcaaaaacaacaa

SEQ ID NO: 311231 - DNA, 972 bp, Homo sapiens
  misc_feature (780)..(780): n is a, c, g, or t
  misc_feature (927)..(927): n is a, c, g, or t
gcagagacagcagccagaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaaaaaaaaaaaaaaagnggggggccgccgcacccaattccttatatagtggagttgaatacaactgacctgccgttactaaacgacggactggacagaacactggccttggcgctaccttaattgaattggcatgcaataacactttttttttcggtcaggtgnagtaataaaggaagaggcccgggacccgttttgccttaactaaga

SEQ ID NO: 311232 - DNA, 590 bp, Homo sapiens
gcagagacagcagccagaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagagtgactagagtggcggtaccgg

SEQ ID NO: 311233 - DNA, 765 bp, Homo sapiens
gcagagacagcagccagaggaaccgagaggctgagactaacccagaaacatccaattctcaaactgaagctcgcactctcgcctccagcatgaaagtctctgccgcccttctgtgcctgctgctcatagcagccaccttcattccccaagggctcgctcagccagatgcaatcaatgccccagtcacctgctgttataacttcaccaataggaagatctcagtgcagaggctcgcgagctatagaagaatcaccagcagcaagtgtcccaaagaagctgtgatcttcaagaccattgtggccaaggagatctgtgctgaccccaagcagaagtgggttcaggattccatggaccacctggacaagcaaacccaaactccgaagacttgaacactcactccacaacccaagaatctgcagctaacttattttcccctagctttccccagacaccctgttttattttattataatgaattttgtttgttgatgtgaaacattatgccttaagtaatgttaattcttatttaagttattgatgttttaagtttatctttcatggtactagtgttttttagatacagagacttggggaaattgcttttcctcttgaaccacagttctacccctgggatgttttgagggtctttgcaagaatcattaatacaaagaattttttttaacattccaatgcattgctaaaatattattgtggaaatgaatattttgtaactattacaccaaataaatatatttttgtacaaaa

SEQ ID NO: 311234 - DNA, 1494 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311235 - DNA, 1928 bp, Homo sapiens
tcttaccgccatcttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattccgaagcaatcttcctgctaaggccattggacacagaatccgagtgatgctgtacccctcaaggatttaaactaacgaaaaatcaataaataaatgtggatttgtgctcttgtaaaaaaaaaaaaaaaaaaaaaaaaaaaaaaaaaaaaaaaggttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311236 - DNA, 823 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgcacgcagtgcatgatgttcaagcggccacctgagcaaggacattcgggctgtgtgcaaggaaagtcattgcggatccatggacgggttgtggcccgacgagaccagctcaagcctgacggcctgcagattctattcaaatcacaacgtgaaagaacggagcttg

SEQ ID NO: 311237 - DNA, 1855 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaaaaaaaaaaaacaaaacaaaaaaaaaaacctttttggggcgcgcctggggccccccgaaaagagcttttaaaaaccaattcggtgggggcgcgcgggggccccaagatagggtacaggctaccaccggggcacaaagacgcgtgttcccatagggagaacccgcgggacaagcacacaaaggtgacgggggaaattcccccccacgtctagaataaaagcgccccgggggggacaaacgcaaaacgcttctcgagcaaccaacccgcaaaacggggaaactcgagggaaccacacacgagggacatctcccacacagggggagaccccaagggaaggcgcgacgaatatgaaaatatagggc

SEQ ID NO: 311238 - DNA, 1522 bp, Homo sapiens
gcccacacacacgacaacactacggctaagaagaagacccgcggtttaactcgaccacgcagcggcacccgttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311239 - DNA, 1943 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcggtgagtgcgagccgcccgccaaggctgcagggagcaccaccaggagcccagtgtctgacggcctccacttgtttctcctgcaccccagcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaaaaaaaaaaaacaaaacaaaaaaaaaaacctttttggggcgcgcctggggccccccgaaaagagcttttaaaaaccaattcggtgggggcgcgcgggggccccaagatagggtacaggctaccaccggggcacaaagacgcgtgttcccatagggagaacccgcgggacaagcacacaaaggtgacgggggaaattcccccccacgtctagaataaaagcgccccgggggggacaaacgcaaaacgcttctcgagcaaccaacccgcaaaacggggaaactcgagggaaccacacacgagggacatctcccacacagggggagaccccaagggaaggcgcgacgaatatgaaaatatagggc

SEQ ID NO: 311240 - DNA, 1837 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggattgtgagtagggcgagagtggcagctttggccttccccaggggcctggagcctggggccccaggacacccgcacggcccacatggcacggaggatgctgggatgctgggagccggcggagcctcctttcctcccctcggtcttgtcaaactgggagtcaagcttggtccacacctgagtcgggccagagcttacatccagcttttgagcgatgtttactgaggtctggtgcagcaggtcctctgggaagtgtcgcacaaaggagtcgcccactggaaggttctgggcaggcgagatgcccagaggtgatccctgcccgcccctcccacctcccttcccacacagcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311241 - DNA, 1679 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctgggctcccctccctgaagcgtggctcgaggcgcacgggcacggctgctccgcgccagcgtgtaagtggattgcagctcctcccgcgcctgcgctcgctggccaccccccagcccctcaggcaccaggactggccactcccgcggctcactctgccctcgtcacggtgccactggctccctggcacagacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311242 - DNA, 1520 bp, Homo sapiens
ccttgccatggctgcccgtggtgtcatcgctccagttggcgagagttgcgctacgctgagtacttgcagccctcggccaaacggccagacgccgacgtcgaccagcagagacagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311243 - DNA, 1895 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctgggctcccctccctgaagcgtggctcgaggcgcacgggcacggctgctccgcgccagcgtacatgcggcgggatgtgcaggagatcttccgcctgacaccacacgagaagcagtgcatgatgttcagcgccaccctgagcaaggacatccggcctgtgtgcaggaagttcatgcaggattgtgagtagggcgagagtggcagctttggccttccccaggggcctggagcctggggccccaggacacccgcacggcccacatggcacggaggatgctgggatgctgggagccggcggagcctcctttcctcccctcggtcttgtcaaactgggagtcaagcttggtccacacctgagtcgggccagagcttacatccagcttttgagcgatgtttactgaggtctggtgcagcaggtcctctgggaagtgtcgcacaaaggagtcgcccactggaaggttctgggcaggcgagatgcccagaggtgatccctgcccgcccctcccacctcccttcccacacagcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311244 - DNA, 1828 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgagggtacgccttctgggtgttatcctcttgcccaggtcctcaccaagacaagaccagccctgcccgcccagagcggtgccgcctccagtttgccgtgggtgagggaggggcccgtctgtcccgcggatcagttgtgcccagcggggcctgtggctgccctcggcagtggggcgttctgctttgaccaggcggataccccagccctgcaggtgtctgtggccttgtccggactcggcctcttctgattgccctcactgtgggcccccggtcaactggtgaggatcctgcacgggggtgcatccaggttctcgtccctcacgctctgcttctcctgcagtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311245 - DNA, 1640 bp, Homo sapiens
gcggacgacggagcagatgaagaaactgatgtcttgtgactgtgacgtgacttgccccccagccatgtatctgagaccatgtctggcctgactgatctgggagcaagcaagctctgctatgggcgagtagacgaggtgtgataggcatggagagaatcctctacagggaatgtgacagaaccgaacacatagattgtagcactcgtatcgtgtgctgtacaccgcagattcatcagcatgtctcactgcctgagtgaggacatgtgcggcggggagtcacataacaggtgctgccactccctcctaggtgcgtagagacattgcacggagagctttgacgtgccatggaacgctgggaaggcgtctgtggcaggtggcgagtgcaggtgaagggtgtgtgcttgtggcaggcaagtgctcgtgtgctcgaggggcgcagcggtgagtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311246 - DNA, 1458 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311247 - DNA, 1360 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcgtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctgggctcccctccctgaagcgtggctcgaggcgcacgggcacggctgctccgcgccagcgtacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311248 - DNA, 1870 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgagggttctcgtccctcacgctctgcttctcctgcagtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggattgtgagtagggcgagagtggcagctttggccttccccaggggcctggagcctggggccccaggacacccgcacggcccacatggcacggaggatgctgggatgctgggagccggcggagcctcctttcctcccctcggtcttgtcaaactgggagtcaagcttggtccacacctgagtcgggccagagcttacatccagcttttgagcgatgtttactgaggtctggtgcagcaggtcctctgggaagtgtcgcacaaaggagtcgcccactggaaggttctgggcaggcgagatgcccagaggtgatccctgcccgcccctcccacctcccttcccacacagcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311249 - DNA, 1641 bp, Homo sapiens
aggcggaaggctcttgagtgggttacatgggcggccggcaggcggggctcctgtggtgatcttggggaaagctctgctgctggcagagggatgtgctgtttctgagcccgagccgaatgggaccacggggcccaagcaagcccccgtccctcctggacgtaaaggcatgcacacatacctctgggagtatgaggcttctgccacctgttgggttggttccaggccccgcctgccctcagtgagccccgacagggccggtgggagatgggcttgtgtcctgggaggcagctgcagctctcaccccagcggctgtctctgcctcaggctcccctccctgaagcgtggctcgaggcgcacgggcacggctgctccgcgccagcgtgtaagtggattgcagctcctcccgcgcctgcgctcgctggccaccccccagcccctcaggcaccaggactggccactcccgcggctcactctgccctcgtcacggtgccactggctccctggcacagacatgcggcgggatgtgcaggagatcttccgcctgacaccacacgagaagcagtgcatgatgttcagcgccaccctgagcaaggacatccggcctgtgtgcaggaagttcatgcaggattgtgagtagggcgagagtggcagctttggccttccccaggggcctggagcctggggccccaggacacccgcacggcccacatggcacggaggatgctgggatgctgggagccggcggagcctcctttcctcccctcggtcttgtcaaactgggagtcaagcttggtccacacctgagtcgggccagagcttacatccagcttttgagcgatgtttactgaggtctggtgcagcaggtcctctgggaagtgtcgcacaaaggagtcgcccactggaaggttctgggcaggcgagatgcccagaggtgatccctgcccgcccctcccacctcccttcccacacagcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311250 - DNA, 434 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcctatacagttggcatgggcccaaccccctaaccaggcaaaggaattttgaa

SEQ ID NO: 311251 - DNA, 478 bp, Homo sapiens
cgtagacagagtcgacaaggaagtcgctcaggaagtcgacaagatggtagaagacgaagtgggaatagaaatcgatcaagaagtgggggccacaaacggagttttgactgagtatttgatagttaatctaccagtgtgagcttgcctatttctgcctaatcatgtacattatccaccaaaaattaggtcatcatagttgaggtacgtgtccggccagtggccggacacgtagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311252 - DNA, 1815 bp, Homo sapiens
aggcggaaggctcttgagtgggttacatgggcggccggcaggcggggctcctgtggtgatcttggggaaagctctgctgctggcagagggatgtgctgtttctgagcccgagccgaatgggaccacggggcccaagcaagcccccgtccctcctggacgtaaaggcatgcacacatacctctgggagtatgaggcttctgccacctgttgggttggttccaggccccgcctgccctcagtgagccccgacagggccggtgggagatgggcttgtgtcctgggaggcagctgcagctctcaccccagcggctgtctctgcctcaggctcccctccctgaagcgtggctcgaggcgcacgggcacggctgctccgcgccagcgtgtaagtggattgcagctcctcccgcgcctgcgctcgctggccaccccccagcccctcaggcaccaggactggccactcccgcggctcactctgccctcgtcacggtgccactggctccctggcacaggttgggaggggtctgggtctggtctggggtgggggtcctgcatggcagacgctcatgcccacccatgtcttgccctccccacctagacatgcggcgggatgtgcaggagatcttccgcctgacaccacacgagaagcagtgcatgatgttcagcgccaccctgagcaaggacatccggcctgtgtgcaggaagttcatgcaggattgtgagtagggcgagagtggcagctttggccttccccaggggcctggagcctggggccccaggacacccgcacggcccacatggcacggaggatgctgggatgctgggagccggcggagcctcctttcctcccctcggtcttgtcaaactgggagtcaagcttggtccacacctgagtcgggccagagcttacatccagcttttgagcgatgtttactgaggtctggtgcagcaggtcctctgggaagtgtcgcacaaaggagtcgcccactggaaggttctgggcaggcgagatgcccagaggtgatccctgcccgcccctcccacctcccttcccacacagcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcggtgagtgcgagccgcccgccaaggctgcagggagcaccaccaggagcccagtgtctgacggcctccacttgtttctcctgcaccccagcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311253 - DNA, 1578 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacagtaagtgccttgggcagggccaggggtctggggcagagggttcctcccccggcccttcagttcactgcatctcatgtcttacagtcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311254 - DNA, 1448 bp, Homo sapiens
cacgagggcccctagcagttacggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311255 - DNA, 1925 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggattgtgagtagggcgagagtggcagctttggccttccccaggggcctggagcctggggccccaggacacccgcacggcccacatggcacggaggatgctgggatgctgggagccggcggagcctcctttcctcccctcggtcttgtcaaactgggagtcaagcttggtccacacctgagtcgggccagagcttacatccagcttttgagcgatgtttactgaggtctggtgcagcaggtcctctgggaagtgtcgcacaaaggagtcgcccactggaaggttctgggcaggcgagatgcccagaggtgatccctgcccgcccctcccacctcccttcccacacagcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcggtgagtgcgagccgcccgccaaggctgcagggagcaccaccaggagcccagtgtctgacggcctccacttgtttctcctgcaccccagcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311256 - DNA, 1500 bp, Homo sapiens
gggaaattgaggaaaaatatggctaggtacgagctggtggtatgtcggtgcgggatctgagtagtgcgctggacatgcgcgtagctgtatcattgcgactatgcatgtcaaagtgagtcttatgtgtcgctccatccctatgatgagtcgcattaatttcgagtagagccagagttaactctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311257 - DNA, 1826 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgagtccctcgggccagactggaccaggcgccacttggtttctgcagctttgttagcctcggctctggcccagccagcatttaccaagcttggcaggggcagctgcctttgaggtttgcggtggtttttgctccttaaaagcctgatgaattatgcatggctcccaggggcctgcgcaggtcccagcctggggctgcctttgagtggagccccgggaggctctcaggcctgccttggtcccctgaggcctcctgttcgcaggtgctgggccgtgcaggttggggccttgggccgtgtatcagcatggagcggtttcctcctcatccccatagtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311258 - DNA, 2011 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggtgagtccctcgggccagactggaccaggcgccacttggtttctgcagctttgttagcctcggctctggcccagccagcatttaccaagcttggcaggggcagctgcctttgaggtttgcggtggtttttgctccttaaaagcctgatgaattatgcatggctcccaggggcctgcgcaggtcccagcctggggctgcctttgagtggagccccgggaggctctcaggcctgccttggtcccctgaggcctcctgttcgcaggtgctgggccgtgcaggttggggccttgggccgtgtatcagcatggagcggtttcctcctcatccccatagtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctgggctcccctccctgaagcgtggctcgaggcgcacgggcacggctgctccgcgccagcgtgtaagtggattgcagctcctcccgcgcctgcgctcgctggccaccccccagcccctcaggcaccaggactggccactcccgcggctcactctgccctcgtcacggtgccactggctccctggcacagacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311259 - DNA, 1487 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcgtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctgggctcccctccctgaagcgtggctcgaggcgcacgggcacggctgctccgcgccagcgtgtaagtggattgcagctcctcccgcgcctgcgctcgctggccaccccccagcccctcaggcaccaggactggccactcccgcggctcactctgccctcgtcacggtgccactggctccctggcacagacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311260 - DNA, 1298 bp, Homo sapiens
aggcggaaggctcttgagtgggttacatgggcggccggcaggcggggctcctgtggtgatcttggggaaagctctgctgctggcagagggatgtgctgtttctgagcccgagccgaatgggaccacggggcccaagcaagcccccgtccctcctggacgtaaaggcatgcacacatacctctgggagtatgaggcttctgccacctgttgggttggttccaggccccgcctgccctcagtgagccccgacagggccggtgggagatgggcttgtgtcctgggaggcagctgcagctctcaccccagcggctgtctctgcctcaggctcccctccctgaagcgtggctcgaggcgcacgggcacggctgctccgcgccagcgtgtaagtggattgcagctcctcccgcgcctgcgctcgctggccaccccccagcccctcaggcaccaggactggccactcccgcggctcactctgccctcgtcacggtgccactggctccctggcacagacatgcggcgggatgtgcaggagatcttccgcctgacaccacacgagaagcagtgcatgatgttcagcgccaccctgagcaaggacatccggcctgtgtgcaggaagttcatgcaggatcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311261 - DNA, 1468 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcgtgtctgtgttcttcggtggtctctccatcaagaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctgggctcccctccctgaagcgtggctcgaggcgcacgggcacggctgctccgcgccagcgtacatgcggcgggatgtgcaggagatcttccgcctgacaccacacgagaagcagtgcatgatgttcagcgccaccctgagcaaggacatccggcctgtgtgcaggaagttcatgcaggatgtcctctgggaagtgtcgcacaaaggagtcgcccactggaaggttctgggcaggcgagatgcccagaggtgatccctgcccgcccctcccacctcccttcccacacagcccatggaggtgtttgtggacgacgagaccaagctcacgctgcacggcctgcagcagtactacgtcaaactcaaagacagtgagaagaaccgcaagctctttgatctcttggatgtgctggagtttaaccaggtgataatcttcgtcaagtcagtgcagcgctgcatggccctggcccagctcctcgtggagcagaacttcccggccatcgccatccaccggggcatggcccaggaggagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311262 - DNA, 1166 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggaagagccccaggctcctcaagagagcacaccagctccccctaagaaagacatcaagggatcctacgtttccatccacagctctggcttccgggactttctgctgaagccggagctcctgcgggccatcgtggactgtggctttgagcatccttctgaggtccagcatgagtgcattccccaggccatcctgggcatggacgtcctgtgccaggccaagtccgggatgggcaagacagcggtcttcgtgctggccaccctacagcagattgagcctgtcaacggacaggtgacggtcctggtcatgtgccacacgagggagctggccttccagatcagcaaggaatatgagcgcttttccaagtacatgcccagcgtcaaggatgaagaagtgttgaagaagaactgtccccatgtcgtggtggggaccccgggccgcatcctggcgctcgtgcggaataggagcttcagcctaaagaatgtgaagcactttgtgctggacgagtgtgacaagatgctggagcagctggacatgcggcgggatgtgcaggagatcttccgcctgacaccacacgagaagcagtgcatgatgttcagcgcctgtcacgctatcagcagttcaaggatttccagcggcggatcctggtggccaccaatctgtttggccgggggatggacatcgagcgagtcaacatcgtctttaactacgacatgcctgaggactcggacacctacctgcaccgggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311263 - DNA, 446 bp, Homo sapiens
gagcgcagcaactcgtgtctgagcgcccggcggaaaaccgaagttggaagtgtctcttagcagcgcgcggagaagaacggggagccagcatcatggcagaacaggatgtggaaaacgatcttttggattacgatgaagaggacctgatcctgtctgcctgcaggtggcccgggcgggtcgctttggcaccaaaggcctagccatcacttttgtgtctgacgagaatgatgccaaaatcctcaatgacgtccaggaccggtttgaagttaatgtggcagaacttccagaggaaatcgacatctccacatacatcgagcagagccggtaaccaccacgtgccagagccgcccacccggagccgcccgcatgcagcttcacctcccctttccaggcgccactgttgagaagctagagattgtatgagaataaacttgttattatggaaa

SEQ ID NO: 311264 - DNA, 178 bp, Homo sapiens
ggcagaggttgcagtgagccgagattgtgccattgcactccagcctgggtgacagagtgagactctgtctccaaaaaaaaagaatataaatctctaatatgactgtgtatgtgactgaagttagactttttttattggtcctggatctaattgtctccattctgacagataactaaat

SEQ ID NO: 311265 - DNA, 290 bp, Homo sapiens
gtgatccacccgccttggcctcccaaagtgctgggattacaggtgtgagccaccgtgcccagccataaattattataaaaatgatagtgaaacctctggacagcttggcaaaaacaaaaacgaaacttcacaggagaccccattaatcaggcctcacaaaattcctacacataaagccgtgtttatgatgagctcacaattcaaaaatataaaacagttgaaaaaagatttcactatgagcaagagacagcaggattagacactcaagaacttcagataatgaaacaatc

SEQ ID NO: 311266 - DNA, 2167 bp, Homo sapiens
ctggaaagacccgcccagcggtgctgtcgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagttcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactatttgtttcaaataaaaacatttagacaaaaaaaaacagttatg

SEQ ID NO: 311267 - DNA, 837 bp, Homo sapiens
  misc_feature (675)..(676): n is a, c, g, or t
ctggaaagacccgcccagcggtgctgtcgctcgcgctggaagaagcggaagaagatggcgctcaccagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattnntaaggaaattccaccggggagcactttatcctccagcgtcgactcaagagtttcctttctggaagatgattataaaggtacgacaagagtgtaagattcctcttgttatatttatctgatgtgcgacattgtgagaataccggtcccattccgacgcatgt

SEQ ID NO: 311268 - DNA, 2151 bp, Homo sapiens
  misc_feature (21)..(21): n is a, c, g, or t
  misc_feature (36)..(36): n is a, c, g, or t
  misc_feature (53)..(53): n is a, c, g, or t
  misc_feature (121)..(121): n is a, c, g, or t
  misc_feature (132)..(132): n is a, c, g, or t
  misc_feature (143)..(144): n is a, c, g, or t
  misc_feature (146)..(147): n is a, c, g, or t
  misc_feature (156)..(156): n is a, c, g, or t
  misc_feature (172)..(172): n is a, c, g, or t
  misc_feature (183)..(184): n is a, c, g, or t
  misc_feature (191)..(191): n is a, c, g, or t
  misc_feature (193)..(193): n is a, c, g, or t
  misc_feature (198)..(198): n is a, c, g, or t
  misc_feature (204)..(204): n is a, c, g, or t
  misc_feature (211)..(212): n is a, c, g, or t
  misc_feature (234)..(234): n is a, c, g, or t
  misc_feature (315)..(315): n is a, c, g, or t
ctggaagaagcggaagaaganggcgctaaaaagctntattaaatgaacataancaactaaataaggaccaaaatgaagctgaaaaaaaagaaaaaaaacaaaaaaaaaggaaaaaatcaanggtaacatcangaaaaaaaaannanncgtaagganaaaggaaaagatgganaaatcggttannaaaagantntgganaaggangtgcttnnaaaaaaaaaaaagtggccaaanaaaaaatggaaaagggaaaaaaaaaaaaaaagtagaaagcgctggcaaataaagtggaatataaaaaaaaaaaaaaaaaanaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagttcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactatttgtttcaaataaaaacatttagacaaaaaaaaacagttatg

SEQ ID NO: 311269 - DNA, 1892 bp, Homo sapiens
aacttagagaaatggcccagaaagccagggaaagaagagctgggatcaaaactcatgtggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagttcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactatttgtttcaaataaaaacatttagacaaaaaaaaacagttatg

SEQ ID NO: 311270 - DNA, 2131 bp, Homo sapiens
  misc_feature (21)..(21): n is a, c, g, or t
  misc_feature (36)..(36): n is a, c, g, or t
  misc_feature (53)..(53): n is a, c, g, or t
  misc_feature (121)..(121): n is a, c, g, or t
  misc_feature (132)..(132): n is a, c, g, or t
  misc_feature (143)..(144): n is a, c, g, or t
  misc_feature (146)..(147): n is a, c, g, or t
  misc_feature (156)..(156): n is a, c, g, or t
  misc_feature (172)..(172): n is a, c, g, or t
  misc_feature (183)..(184): n is a, c, g, or t
  misc_feature (191)..(191): n is a, c, g, or t
  misc_feature (193)..(193): n is a, c, g, or t
  misc_feature (198)..(198): n is a, c, g, or t
  misc_feature (204)..(204): n is a, c, g, or t
  misc_feature (211)..(212): n is a, c, g, or t
  misc_feature (234)..(234): n is a, c, g, or t
  misc_feature (315)..(315): n is a, c, g, or t
  misc_feature (323)..(323): n is a, c, g, or t
  misc_feature (334)..(334): n is a, c, g, or t
  misc_feature (359)..(359): n is a, c, g, or t
  misc_feature (371)..(371): n is a, c, g, or t
  misc_feature (382)..(382): n is a, c, g, or t
  misc_feature (394)..(394): n is a, c, g, or t
  misc_feature (415)..(415): n is a, c, g, or t
  misc_feature (427)..(427): n is a, c, g, or t
  misc_feature (435)..(435): n is a, c, g, or t
ctggaagaagcggaagaaganggcgctaaaaagctntattaaatgaacataancaactaaataaggaccaaaatgaagctgaaaaaaaagaaaaaaaacaaaaaaaaaggaaaaaatcaanggtaacatcangaaaaaaaaannanncgtaagganaaaggaaaagatgganaaatcggttannaaaagantntgganaaggangtgcttnnaaaaaaaaaaaagtggccaaanaaaaaatggaaaagggaaaaaaaaaaaaaaagtagaaagcgctggcaaataaagtggaatataaaaaaaaaaaaaaaaaanaagaaaangctcgaaaaanaaaataaaaaaaaaaggtaaattanaaaaaaaaaaangaaatggttcnaaagaaagttanaaatgaagaagaaacaaaaangaaaaaaacgangaagaaanattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagttcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactatttgtttcaaataaaaacatttagacaaaaaaaaacagttatg

SEQ ID NO: 311271 - DNA, 1430 bp, Homo sapiens
ctggaaagacccgcccagcggtgctgtcgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatgcccgtggatttgcggtggagaaagatgaaattttaggtttgatcagccggggaagggggagatatggccagttttttggccgaaactgggcaggcgttgtgggacaacaaaaacaatgtcca

SEQ ID NO: 311272 - DNA, 148 bp, Homo sapiens
aatgtaaactccacaagaggcagggaactctgctgtatctctagcatctagcatactaaggactcaacaattacttgttgaatgaatgaatatatcttgaatgtcaaatgatgattaactattttatttaactacttctaatgtgtag

SEQ ID NO: 311273 - DNA, 143 bp, Homo sapiens
ataacagaaaagacaagagtagccttagaaaaatctgtatcacagaaggtcgccgcagccatgccagttcgagcagctgacaaattggctcctgctcagtatatccggtatgaatcatgcctagaagacttagtttcattctg

SEQ ID NO: 311274 - DNA, 545 bp, Homo sapiens
ccagcctgggtgacagagtgagatgctgtctctttttaaaaaattatatatatacacacgtgtacacgtatgcacacatataatacatattacagtgaagtacttttcaactgttcacacagaggatggggaggcacgtgagagggatgaaatccggcatgacaggcgaaaagagagacagcatgaccggaatctttccagggcagctcctgataagaggtaggtgttatttaagatgtgtaccaatcatggtggccgggcgcagtggttcacccctgtaatcccagcactttgggaggccaatgcgggcggatcacgaggtcaggagatcgagaccatcctggctaacacgatgaaaccctgtgtctactaaaagtacaaaaaattagccgggcatggtcgtggcaggcgcctgtagtcccagctacttggcaggctgaggcaggagaatggcgtgaacccgggaggtggagcttgcagtgagccgagatcacgccactgcattccagcctgggcgacagagcgagactccatctcacaaaaaa

SEQ ID NO: 311275 - DNA, 2070 bp, Homo sapiens
ctggaaagacccgcccagcggtgctgtcgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagttcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactatttgtttcaaataaaaacatttagacaaaaaaaaacagttatg

SEQ ID NO: 311276 - DNA, 2128 bp, Homo sapiens
ctggaaagacccgcccagcggtgctgtcgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagttcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagaaaattctactttgaattatttagttttttttaaagagtgggttgtgtttgtgcttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactatttgtttcaaataaaaacatttagacaaaaaaaaacagttatg

SEQ ID NO: 311277 - DNA, 2113 bp, Homo sapiens
ctggaaagacccgcccagcggtgctgtcgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattaataagaaaattccccggggaccaccttctcctcctgcgcctgtcatgcattctcctagccgaaagatgactgtaaaggaacaacaagagtggaagattcctccttgtatttctaactggaaaaatgcaaagggttatacaattccattagacaaacgtctggctgctgatggaagaggactacagacagtacacataaatgaaaatttcgccaaattggcagaagccctctacattgctgatcggaaggctcgtgaagctgtggaaatgcgtgcccaagtagagagaaaaatggctcagaaagaaaaggaaaaacatgaagagaaacttagagaaatggcccagaaagccagggagagaagagctgggatcaaaactcatgtggaaaaagaggatggggaggcacgtgagagggatgaaatccggcatgacaggcgaaaagagagacagcatgaccggaatctttccagggcagctcctgataagaggtcgaaacttcagagaaatgaaaatcgggatatcagtgaagttattgctctcggtgttcctaatcctcggacttccaatgaagttcagtatgaccaaaggctcttcaaccaatccaagggtatggacagtggatttgcaggtggagaagatgaaatttataatgtttatgatcaagcctggagaggtggtaaagatatggcccagagtatttataggcccagtaaaaatctggacaaggacatgtatggtgatgacctagaagccagaataaagaccaacagatttgttcccgacaaggagttttctggttcagaccgtagacagagaggccgagaaggaccagttcagtttgaggaagatccttttggtttggacaagtttttggaagaagccaaacagcatggtggctctaaaagaccctcagatagcagccgccccaaggaacacgagcatgaaggcaagaagaggaggaaggaataggcacaggtctctccaaagtgaatgaactcttacccataaccctaatgatgcaagtcatatgggggaacactttgtaaatggtcaggataaaaaccaaatctgggtgccagatcccagcactactttttattactggagaaatgggggggatagttctcccacctttcagcatttatagaacatgctgccccacatacaaagtcaagaccacttacttttatgtgacactagtagtttggggttaatgttttgtgtaagaacagctgcatatgagtaaagttaccccaaccacagtgaggaggaagatgttcacatactggaactgtcctgccaaataaattttgcccctattgtgctctgttttaatttggagtgggcaaagtaacctcttgcttggtgcaactatttgtttcaaataaaaacatttagacaaaaaaaaacagttatg

SEQ ID NO: 311278 - DNA, 859 bp, Homo sapiens
  misc_feature (697)..(698): n is a, c, g, or t
ctggaaagacccgcccagcggtgctgtcgctcgcgctggaagaagcggaagaagatggcgctcaccagctttttacctgcacctactcagctatctcaggaccagcttgaggctgaagaaaaggcaagatcccagagatcacggcagacctcactggtctcctcccgaagagaacctcccccgtacggataccggaaaggctggatacctcggttattagaggattttggagatggaggtgcttttccagagatccatgtggcccagtatccactggatatgggacgaaagaaaaaaatgtcgaatgcgctggccattcaggtggattctgaaggaaaaattaaatatgatgcaattgctcgacaaggacagtcaaaagacaaggtcatttatagcaaatacactgacctggttccaaaggaggttatgaatgcagatgatccagacctgcaaaggcccgatgaagaagctattaaagagataacagaaaagacaagagtagccttagaaaaatctgtatcacagaaggtcgccgcagccatgccagttcgagcagctgacaaattggctcctgctcagtatatccgatacacaccatctcagcaaggagtggcattcaactctggagctaaacagagggttattcggatggtagaaatgcagaaagatccaatggagcctccaaggttcaagattnntaaggaaattccaccggggagcactttatcctccagcgtcgactcaagagtttcctttctggaagatgattataaaggtacgacaagagtgtaagattcctcttgttatatttatctgatgtgcgacattgtgagaataccggtcccattccgacgcatgt

SEQ ID NO: 311279 - DNA, 388 bp, Homo sapiens
caaacatttgttggccacctttcaagtgccagacaacccttctaggtatggaggggtacagtgatgagcaagccactgtttctggctgcagagggctcactgtttagtgggagaaacagacaaatcatacatcttaactacactgcccttgattgctctttacctgttatatcagtcgatcttgcctgcctagcatttgttccctgtttgggggcctgtatgatgttcgtttggatacctcagggtacattttcccatctttgtgatgatgtagctcacttggtctgaatgatatgtaatcctgcacatgtagagtgaccattatatttgcataaatagcattggaggaatatataagaaatgaataaaagttgttatatcatttgat

SEQ ID NO: 311280 - DNA, 2572 bp, Homo sapiens
ggcaggaccgaaccgctccttctttaaatatataaatttcagcccaggtcagcctcggcggcccccctcaccgcgctcccggcgccctcccgtcagttcgccagctgccagccccgggaccttttcatctcttcccttttggccggagagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaaatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaaaaa

SEQ ID NO: 311281 - DNA, 2259 bp, Homo sapiens
ggcaggaccgaaccgctccttctttaaatatataaatttcagcccaggtcagcctcggcggcccccctcaccgcgctcccggcgccctcccgtcagttcgccagctgccagccccgggaccttttcatctcttcccttttggccggagagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaaatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaatagccgcatccaagcgggatcctgctagagtcacctcgct

SEQ ID NO: 311282 - DNA, 1568 bp, Homo sapiens
  misc_feature (29)..(29): n is a, c, g, or t
gcttaataataagactaggctaaaacaanatttaaaacaaaaagcaaaagtttaattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaaaaa

SEQ ID NO: 311283 - DNA, 1576 bp, Homo sapiens
  misc_feature (61)..(61): n is a, c, g, or t
actcatacacttagttatttttagataatagcgacttaactcgaagacacccggcttttantattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaaaaa

SEQ ID NO: 311284 - DNA, 1572 bp, Homo sapiens
tctgatacatatcattaattaattttacgcattgagcttataataagtatattacttaattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaaaaa

SEQ ID NO: 311285 - DNA, 462 bp, Homo sapiens
gtaagtacttattttgacttccatcccctgaggtttagctctgcccggagctctcaaaaccgcagcagctcccgggatcgcccttccctctcgcggttcccgttcgctcttttcccgttctcctgtccttcaccccaccacctccttttcagttgtatgcttgaggccatcaggctttaaaatgtttactttctactttattttctccatctttcccttccccctaacaattcggtgctttaaaaggcgttattctctttttctcttccctgaagttctttagtcggccaccagctaggagtcagccccactctgtcaaactagaggtgctcccaggggcagagttaaactgaggaatcttggtaggtttgttttctttgctccgattggcgtggagcgcgccgaactggtgcacgaagggttaaaaaaagtgtctcaaaactagcctctccggaaggcgcc

SEQ ID NO: 311286 - DNA, 2656 bp, Homo sapiens
ggcaggaccgaaccgctccttctttaaatatataaatttcagcccaggtcagcctcggcggcccccctcaccgcgctcccggcgccctcccgtcagttcgccagctgccagccccgggaccttttcatctcttcccttttggccggagagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaactgtctgcccagttgttacaacaccctctggctcagtgggcagcttgtgctccagacagtcccaggtgctctgtgggtaccttgatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaaaaa

SEQ ID NO: 311287 - DNA, 2410 bp, Homo sapiens
gttccctgtgtgagaagcactgaccgaccgtgactcgatatccccctggtgaatctttgtgtacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaaatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaaaaa

SEQ ID NO: 311288 - DNA, 1634 bp, Homo sapiens
ggcaggaccgaaccgctccttctttaaatatataaatttcagcccaggtcagcctcggcggcccccctcaccgcgctcccggcgccctcccgtcagttcgccagctgccagccccgggaccttttcatctcttcccttttggccggagagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaactgtctgcccagttgttacaacaccctctggctcagtgggcagcttgtgctccagacagtcccaggtgctctgtgggtaccttgatgccatcccgcccactttctacagaccctacttcagaattgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaaaaa

SEQ ID NO: 311289 - DNA, 1567 bp, Homo sapiens
  misc_feature (42)..(42): n is a, c, g, or t
  misc_feature (46)..(47): n is a, c, g, or t
  misc_feature (52)..(52): n is a, c, g, or t
actcaatacttcagtattttgcgaaaatgatgagaacaaaangcgnncttantattctcaagtccaaagatttaacatctccaacccagcgctacatcgacagcaaagttgtgaaaacaagagcagaaggcgaatggctctccttcgatgtaactgatgctgttcatgaatggcttcaccataaagacaggaacctgggatttaaaataagcttacactgtccctgctgcacttttgtaccatctaataattacatcatcccaaataaaagtgaagaactagaagcaagatttgcaggtattgatggcacctccacatataccagtggtgatcagaaaactataaagtccactaggaaaaaaaacagtgggaagaccccacatctcctgctaatgttattgccctcctacagacttgagtcacaacagaccaaccggcggaagaagcgtgctttggatgcggcctattgctttagaaatgtgcaggataattgctgcctacgtccactttacattgatttcaagagggatctagggtggaaatggatacacgaacccaaagggtacaatgccaacttctgtgctggagcatgcccgtatttatggagttcagacactcagcacagcagggtcctgagcttatataataccataaatccagaagcatctgcttctccttgctgcgtgtcccaagatttagaacctctaaccattctctactacattggcaaaacacccaagattgaacagctttctaatatgattgtaaagtcttgcaaatgcagctaaaattcttggaaaagtggcaagaccaaaatgacaatgatgatgataatgatgatgacgacgacaacgatgatgcttgtaacaagaaaacataagagagccttggttcatcagtgttaaaaaatttttgaaaaggcggtactagttcagacactttggaagtttgtgttctgtttgttaaaactggcatctgacacaaaaaaagttgaaggccttattctacatttcacctactttgtaagtgagagagacaagaagcaaattttttttaaagaaaaaaataaacactggaagaatttattagtgttaattatgtgaacaacgacaacaacaacaacaacaacaaacaggaaaatcccattaagtggagttgctgtacgtaccgttcctatcccgcgcctcacttgatttttctgtattgctatgcaataggcacccttcccattcttactcttagagttaacagtgagttatttattgtgtgttactatataatgaacgtttcattgcccttggaaaataaaacaggtgtataaagtggagaccaaatactttgccagaaactcatggatggcttaaggaacttgaactcaaacgagccagaaaaaaagaggtcatattaatgggatgaaaacccaagtgagttattatatgaccgagaaagtctgcattaagataaagaccctgaaaacacatgttatgtatcagctgcctaaggaagcttcttgtaaggtccaaaaactaaaaagactgttaataaaagaaactttcagtcagaaaaa

SEQ ID NO: 311290 - DNA, 1289 bp, Homo sapiens
ggcaggaccgaaccgctccttctttaaatatataaatttcagcccaggtcagcctcggcggcccccctcaccgcgctcccggcgccctcccgtcagttcgccagctgccagccccgggaccttttcatctcttcccttttggccggagagccgagttcagatccgccactccgcacccgagactgacacactgaactccacttcctcctcttaaatttatttctacttaatagccactcgtctctttttttccccatctcattgctccaagaatttttttcttcttactcgccaaagtcagggttccctctgcccgtcccgtattaatatttccacttttggaactactggccttttctttttaaaggaattcaagcaggatacgtttttctgttgggcattgactagattgtttgcaaaagtttcgcatcaaaaacaacaacaacaaaaaaccaaacaactctccttgatctatactttgagaattgttgatttcttttttttattctgacttttaaaaacaacttttttttccacttttttaaaaaatgcactactgtgtgctgagcgcttttctgatcctgcatctggtcacggtcgcgctcagcctgtctacctgcagcacactcgatatggaccagttcatgcgcaagaggatcgaggcgatccgcgggcagatcctgagcaagctgaagctcaccagtcccccagaagactatcctgagcccgaggaagtccccccggaggtgatttccatctacaacagcaccagggacttgctccaggagaaggcgagccggagggcggccgcctgcgagcgcgagaggagcgacgaagagtactacgccaaggaggtttacaaaatagacatgccgcccttcttcccctccgaaaatgccatcccgcccactttctacagaccctacttcagaattgttcgatttgacgtctcagcaatggagaagaatgcttccaatttggtgaaagcagagttcagagtctttcgtttgcagaacccaaaagccagagtgcctgaacaacggattgagctatatcagattctcaagtccaaagatttaacatctccaacccagcgctacatcgacagcaaagttgtgaaaacaagagcagaaggcgaatggctctccttcgatgtaactgatgctgttcatgaatggcttcaccataaaggttacaagccactctctcttttcctcccaagatgttcagtatccctaagttactttaaattgattgcagatttaagggtatagacacacatacaaatg

SEQ ID NO: 311291 - DNA, 415 bp, Homo sapiens
gatcccctgcgcgcgcctgcgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgc

SEQ ID NO: 311292 - DNA, 419 bp, Homo sapiens
gggatgagtggaggatgggatgagtggaggatgggatgagtggcgttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgc

SEQ ID NO: 311293 - DNA, 671 bp, Homo sapiens
gggatgagtggaggatgggatgagtggaggatgggatgagtggcgttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaaaaaaaaaaaaaaacattttgggccccttgggccaagtggattttagacttgggcaagtttatgattgcggccgaaattggggctacattggccaaatccccttatggggggcggattccaattaattggccggggtttacacggtgggattgg

SEQ ID NO: 311294 - DNA, 297 bp, Homo sapiens
  misc_feature (251)..(251): n is a, c, g, or t
cgtcgactgcgttctgagccgtctgtcctgcgccaagataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcaaaaaaaaagtngacgcggccgcgaatttagtagtagtaggcgacccgggtatttctg

SEQ ID NO: 311295 - DNA, 360 bp, Homo sapiens
gtaggaattttaccatttcttggctataagacattttctgaaagcttcctgaattgctttacctaagctacaatgccttcagctaaatgttaattttgacaaaggcatttttgtaaagcattgatatgactgcttttttttccttccttttattttagataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgc

SEQ ID NO: 311296 - DNA, 295 bp, Homo sapiens
tcatgagatgttggaaggccttccaacatctcatggcgtgaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcagatgttggaaggatctcatgtctccttccaacatctcatcactccttccaacatctcat

SEQ ID NO: 311297 - DNA, 1178 bp, Homo sapiens
gggatgagtggaggatgggatgagtggaggatgggatgagtggcgttggctgcagatttgtggtgcgttctgagccgtctgtcctgcgccaaggtgagtacggggacctggacctggctcccgaggtgcgagacggcgggggcgggagggcgagaagccgccttggccccagctgatcttggggttccacccctccgccggcacgcgcctgcttttctgcccggctttcccttctctgaagggaggtaggccagggtcggttgccagagggaagcatcgcctaggcctgcgccgcgtttccctccttggccttaacgcgctcagtgcacctgaattctcccacggttttgacagggagcgtaccttggccttgagaggttcagctgcctaacccagaggctacgcagagttagagaagccagagtccaagccaagaactctgactccacatccagtcccttctctcctttataactcaagtttccttgcgccacactgccctccacgttatgctgtacatgacaacttgggtgaggcaacagggaagctgaaaagagatcatacggtgctgaatgaaattgtatggaactcgcgggtcagacatttcccatttccagtgtcagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgatcctgctactta

SEQ ID NO: 311298 - DNA, 707 bp, Homo sapiens
  misc_feature (478)..(478): n is a, c, g, or t
gatcccctgcgcgcgcctgcgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcaaaaaaaaaaaaaaaaaaaaaaaaaaaaattttggggcgccttgggcccttggaaaagttttntaacacccactcgtgtgggcggcggggccccaagtcaggtacaggtggacacgcggcacataagggggtcccacaggacacccgggaaagcaaaacggccggggcatcacaacacacataagaaaggccgggggggcaccggaacgtctctgaccaactccgagtggagctccgaggggcacaaggggacatacgacacgacgtcacagagactcatattattagcccg

SEQ ID NO: 311299 - DNA, 799 bp, Homo sapiens
gatcccctgcgcgcgcctgcgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgagatggggttttgccatgttacccaggctggtcttgaattcctgggctcaagcagtcctccaatcttggcttcccaaagtgctggaattaacaagcgtgagccacaacacctggcccaattggggaactttgaacaagactttaatatcagaattataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgatcctgctactta

SEQ ID NO: 311300 - DNA, 771 bp, Homo sapiens
cctaattttcccccattcctctaggtaattccaacaaccaaaagggtttgatagctgacagatgcttcaaagtattattaaaaacatatggatccccatgaagccctactacaccaaagtttaccaggagatttggataggaatggggctgatgggcttcatcgtttataaaatccgggctgctgagatggggttttgccatgttacccaggctggtcttgaattcctgggctcaagcagtcctccaatcttggcttcccaaagtgctggaattaacaagcgtgagccacaacacctggcccaattggggaactttgaacaagactttaatatcagaattataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgatcctgctactta

SEQ ID NO: 311301 - DNA, 1909 bp, Homo sapiens
gatcccctgcgcgcgcctgcgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaaggtaagatttttgcttctgaaaatggttgggaatggaaaacagcatcatgtcttttcaggacaaggtatatcgttgttctcaattgaaatcgaaacacagttcagtatatatgtaaggtgcagttgaaatgcttcacagcttgaagtttgctatgcctgctgggaaagagaattctgaatttctgctttttatagtcaagtggatcaagtaaaacttccaggagtaatagaggaatggattaattagaggtagtcgatatcatcaccaatagggaagcacaagtgagctgtgcaagcatgctgtcctagaagttccctaatgatgtcgttttattttgtttattgttttttgagacggagcctcgctctgtcgcccaggctggactgcagtgctgcgatctcagctcactgcaagctccgcctcccaggttcatgccgttctcctgcctcagccttctgagtagctgggactacaggcacctgccgccacgcctggctaatgttttgtatttttagtagagatagggtttcacatagccaggatggtctggatctcctgaccttgtgatccaccgcctcagcctacccgtaatgatgtgtttttaatggtttggttttgttttttgggtttttttttttttgagacagagtctcgctgtgttgcccaggctggagtgcagtggcacaatcttggctcactgcaacctccgccttccaggttcaagcaattctcctgccttagcctcccaagtagctgggattacaggtgcccgccaccatacccggctaattttttgtatttttagtagagatggggttggccggctggtttcaaactcctacctcaggtgatccacctgccttggcctcccaaagtgttgggattacaggcgtgagccactgcgcctggcctttaatgtattttgaaagaaagcgccttataaatttatgccagagtgacaatgaaactgtagccatttgaatgttacacaaacccaggactggctacatgagtttgaggaggaggtgtttccctgcctctctctttgcgctgtgggtgaccactgcctgtctgctgtcattacatgaacccttaagcactctgggtgtttcatatagaaataatcctacttttcaatagtattgaaaggtgtcatttatctttttggactgttgatcaacttcttttgatacttgtttaataaattacatccaacttgttccttccttcttaaatcatatttatatatgcatctctttcaaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgatcctgctactta

SEQ ID NO: 311302 - DNA, 473 bp, Homo sapiens
  misc_feature (427)..(427): n is a, c, g, or t
gatcccctgcgcgcgcctgcgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcaaaaaaaaagtngacgcggccgcgaatttagtagtagtaggcgacccgggtatttctg

SEQ ID NO: 311303 - DNA, 638 bp, Homo sapiens
gatcccctgcgcgcgcctgcgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcaaaaaaaaaaaaaaaaaaaaaaaaaaaaaaaaaaaaaaaaaaaaaaaaaaaaaaaaaaaaaaaaaaagaaaaaaaaaaaaaaacattttgggccccttgggccaagtggattttagacttgggcaagtttatgattgcggccgaaattggggctacattggccaaatccccttatggggggcggattccaattaattggccggggtttacacggtgggattgg

SEQ ID NO: 311304 - DNA, 413 bp, Homo sapiens
  misc_feature (357)..(357): n is a, c, g, or t
gatcccctgcgcgcgcctgcgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacggtacntatacaagtgtacagtgacgttccagtcagacggccgcgaatttagtagtagtagt

SEQ ID NO: 311305 - DNA, 1007 bp, Homo sapiens
  misc_feature (961)..(961): n is a, c, g, or t
gggatgagtggaggatgggatgagtggaggatgggatgagtggcgttggctgcagatttgtggtgcgttctgagccgtctgtcctgcgccaaggtgagtacggggacctggacctggctcccgaggtgcgagacggcgggggcgggagggcgagaagccgccttggccccagctgatcttggggttccacccctccgccggcacgcgcctgcttttctgcccggctttcccttctctgaagggaggtaggccagggtcggttgccagagggaagcatcgcctaggcctgcgccgcgtttccctccttggccttaacgcgctcagtgcacctgaattctcccacggttttgacagggagcgtaccttggccttgagaggttcagctgcctaacccagaggctacgcagagttagagaagccagagtccaagccaagaactctgactccacatccagtcccttctctcctttataactcaagtttccttgcgccacactgccctccacgttatgctgtacatgacaacttgggtgaggcaacagggaagctgaaaagagatcatacggtgctgaatgaaattgtatggaactcgcgggtcagacatttcccatttccagtgtcagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcaaaaaaaaagtngacgcggccgcgaatttagtagtagtaggcgacccgggtatttctg

SEQ ID NO: 311306 - DNA, 1104 bp, Homo sapiens
gggatgagtggaggatgggatgagtggaggatgggatgagtggcgttggctgcagatttgtggtgcgttctgagccgtctgtcctgcgccaaggtgagtacggggacctggacctggctcccgaggtgcgagacggcgggggcgggagggcgagaagccgccttggccccagctgatcttggggttccacccctccgccggcacgcgcctgcttttctgcccggctttcccttctctgaagggaggtaggccagggtcggttgccagagggaagcatcgcctaggcctgcgccgcgtttccctccttggccttaacgcgctcagtgcacctgaattctcccacggttttgacagggagcgtaccttggccttgagaggttcagctgcctaacccagaggctacgcagagttagagaagccagagtccaagccaagaactctgactccacatccagtcccttctctcctttataactcaagtttccttgcgccacactgccctccacgttatgctgtacatgacaacttgggtgaggcaacagggaagctgaaaagagatcatacggtgctgaatgaaattgtatggaactcgcgggtcagacatttcccatttccagtgtcagatgcttcaaagtattattaaaaacatatggatccccatgaagccctactacaccaaagtttaccaggagatttggataggaatggggctgatgggcttcatcgtttataaaatccgggctgctgagatggggttttgccatgttacccaggctggtcttgaattcctgggctcaagcagtcctccaatcttggcttcccaaagtgctggaattaacaagcgtgagccacaacacctggcccaattggggaactttgaacaagactttaatatcagaattataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgc

SEQ ID NO: 311307 - DNA, 644 bp, Homo sapiens
gatcccctgcgcgcgcctgcgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgatcctgctactta

SEQ ID NO: 311308 - DNA, 871 bp, Homo sapiens
gatcccctgcgcgcgcctgcgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgagatggggttttgccatgttacccaggctggtcttgaattcctgggctcaagcagtcctccaatcttggcttcccaaagtgctggaattaacaagcgtgagccacaacacctggcccaattggggaactttgaacaagactttaatatcagaattataaaagaagtaaggctttgaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgcactgctacctggtactgctttcagtgtgttccccctcagcccctccggcgtgtcaggcatactctgagtagataatttgtcatgcagcgcatgcaatcagaatctcactgagccacccatcattgtgaaataattacctcagttgtacaggacttggtgatcaggatccaggcactcacttgtattctactgctcaataaacgtttattaaacttgatcctgctacttaaaaaaaaaaccccaatctattttacatttggaatatgatataatgagaatcaggagtggaaaacccccgtag

SEQ ID NO: 311309 - DNA, 1680 bp, Homo sapiens
gatcccctgcgcgcgcctgcgcgctcggtgacctttccgagttggctgcagatttgtggtgcgttctgagccgtctgtcctgcgccaagatgcttcaaagtattattaaaaacatatggatccccatgaagccctactacaccaaagtttaccaggagatttggataggaatggggctgatgggcttcatcgtttataaaatccgggctgctgataaaagaagtaaggctttgaaaggtaagatttttgcttctgaaaatggttgggaatggaaaacagcatcatgtcttttcaggacaaggtatatcgttgttctcaattgaaatcgaaacacagttcagtatatatgtaaggtgcagttgaaatgcttcacagcttgaagtttgctatgcctgctgggaaagagaattctgaatttctgctttttatagtcaagtggatcaagtaaaacttccaggagtaatagaggaatggattaattagaggtagtcgatatcatcaccaatagggaagcacaagtgagctgtgcaagcatgctgtcctagaagttccctaatgatgtcgttttattttgtttattgttttttgagacggagcctcgctctgtcgcccaggctggactgcagtgctgcgatctcagctcactgcaagctccgcctcccaggttcatgccgttctcctgcctcagccttctgagtagctgggactacaggcacctgccgccacgcctggctaatgttttgtatttttagtagagatagggtttcacatagccaggatggtctggatctcctgaccttgtgatccaccgcctcagcctacccgtaatgatgtgtttttaatggtttggttttgttttttgggtttttttttttttgagacagagtctcgctgtgttgcccaggctggagtgcagtggcacaatcttggctcactgcaacctccgccttccaggttcaagcaattctcctgccttagcctcccaagtagctgggattacaggtgcccgccaccatacccggctaattttttgtatttttagtagagatggggttggccggctggtttcaaactcctacctcaggtgatccacctgccttggcctcccaaagtgttgggattacaggcgtgagccactgcgcctggcctttaatgtattttgaaagaaagcgccttataaatttatgccagagtgacaatgaaactgtagccatttgaatgttacacaaacccaggactggctacatgagtttgaggaggaggtgtttccctgcctctctctttgcgctgtgggtgaccactgcctgtctgctgtcattacatgaacccttaagcactctgggtgtttcatatagaaataatcctacttttcaatagtattgaaaggtgtcatttatctttttggactgttgatcaacttcttttgatacttgtttaataaattacatccaacttgttccttccttcttaaatcatatttatatatgcatctctttcaaaagcttcagcgcctgctcctggtcatcactaaccagatttacttggagtacatgtgaaagaaaacgtcagtctgcctgtaaatttcagcaagccgtgttagatggggagcgtggaacgtcactgtacacttgtataagtaccgtttacttcatggcatgaataaatggatctgtgagatgc

SEQ ID NO: 311310 - DNA, 1093 bp, Homo sapiens
ctgggaattgcagtccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacagatgtttttcagatcctgaattccagcaaaagagctattgccaaccagtttgaagaccgcccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgc

SEQ ID NO: 311311 - DNA, 630 bp, Homo sapiens
ctgggaattgcagtccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaagcattctgtgtgctgaaatgggaagtatgcagaaagaactgctgctgtgtactgacatatcatggttgtctcaaggaaaagcacttgtgagactgggtagtgaaatgaaccagctaccttttatatggaacactatttttctgcatgaaagaagcattgaaagacaaaatataattacgcaaactcaagtatttaacatattttctttaaaatgcacaaagtgagtctgttgctttaagtaaaccgttggccagtatttgttgatagtgataa

SEQ ID NO: 311312 - DNA, 485 bp, Homo sapiens
ctgggaattgcagtccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctgattctaaagtgcatctaagattgaaaaccactgattctaataacacagcattgtggaatgattcgcagctgattctaaagtgcatttaacattgaaaaccactgattctaataacacagcatcgtggaatgaatcaggaactgactcagcacaggaggacagctttgactccctgtgatttcatctccaattcgaccgatcagcactccccactgcctggcccgctacccaccaaattatccttaaaaaatcccagtctctgaaatgttccagggagactgatctcagtaataataaaactctggtctcctgttcagcc

SEQ ID NO: 311313 - DNA, 1174 bp, Homo sapiens
ctgggaattgcagtccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtatcctaggaatacctgcctgcttagaccctctataaaagctctgtgcatcctgccactgaggactccgaagaggtagcagtcttctgaaaggtctccgtcggatcaatcagtggaagaagggggttgctgattcacattacgtaaaaacacaagtcctcacttgagtcatagacttcaactgtgaggacatgtcgttcagatttggccaacatctcatcaagccctctgtagtgtttctcaaaacagaactgtccttcgctcttgtgaataggaaacctgtggtaccaggacatgtccttgtgtgcccgctgcggccagtggagcgcttccatgacctgcgtcctgatgaagtggccgatttgtttcagacgacccagagagtcgggacagtggtggaaaaacatttccatgggacctctctcaccttttccatgcaggatggccccgaagccggacagactgtgaagcacgttcacgtccatgttcttcccaggaaggctggagactttcacaggaatgacagcatctatgaggagctccagaaacatgacaaggaggactttcctgcctcttggagatcagaggaggaaatggcagcagaagccgcagctctgcgggtctactttcagtgacacagatgtttttcagatcctgaattccagcaaaagagctattgccaaccagtttgaagaccgcccccccgcctctccccaagaggaactgaatcagcatgaaaatgcagtttcttcatctcaccatcctgtattcttcaaccagtgatcccccacctcggtcactccaactcccttaaaatacctagacctaaacggctcagacaggcagatttgaggtttccccctgtctccttattcggcagccttatgattaaacttccttctctgctgc

SEQ ID NO: 311314 - DNA, 925 bp, Homo sapiens
ctgggaattgcagtccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaagagtgagaagtggaccttggaccaccctgtctggagtcattccctgggcttctccagcccctgaagaaaatagtctcactcttgtcacccaggctggagtgcaatggctcgatctcggctcactgcaacctctgactcctgggttcaagatattctcctgcctcagtctcccgagtagctggtattacaggcatgcgccaccacacctggctaatttttgtatttttagtagagacagagattcaccatgttggccaggctggtcttgaactgctgaccttgggtgatctgtccacctcagcctcccaaagtgctgggattacaggtatgagccactgtgcccagcctgtcagtcaattttctaggcaatttatagacattactcaaaattttttgaacaggcaaaaaacaagtaactctattaaaagatgggcaaaagatatgaacagacacttcccaaaagaagacatacaagtggccaacaaacatatgagaaaatgctcatcatcactaatcatcagagaaatgcaaatcaaaaccacagtgagataccatctcacactgtcagaatggctattattaaaaagtctaaaaacaacacatgttggtgaggctgtggggaaaaaggatgcttataaactgttgtcgagaatgtaaattaggtcagccactgtggaaagcagtttggagatttctcaaagaacttaaaacagg

SEQ ID NO: 311315 - DNA, 631 bp, Homo sapiens
  misc_feature (564)..(564): n is a, c, g, or t
  misc_feature (571)..(571): n is a, c, g, or t
  misc_feature (597)..(597): n is a, c, g, or t
ctgggaattgcagtccccgctctgctctgtccggtcacaggactttttgccctctgttcccgggtccctcaggcggccacccagtgggcacactcccaggcggcgctccggccccgcgctccctccctctgcctttcattcccagctgtcaacatcctggaagctttgaagctcaggaaagaagagaaatccactgagaacagtctgtaaaggtccgtagtgctatctacatccagacggtggaagggagagaaagagaaagaaggtaaaaccatttcttaaaatacttaacagaattggcacatatgccactggctaaagtcacctggccacacaagcgggtctgttcaaaaataataaatatttagaaggagagatatatgaatttttggtaaacagccttcagttctcacattatactgcactatactttcaagaactacacaaagattttgaaattctcacttttttcattattatcataattacttttgttatatctttaaggtattgttctggttcataacatggcaatttttaatttagcctcaaaaaaggaatttnactggcntttccaaggttaaagggggcaattgnaagggggaaaatcaaggtggaatgggttattaaa

SEQ ID NO: 311316 - DNA, 3876 bp, Homo sapiens
  misc_feature (2902)..(2902): n is a, c, g, or t
  misc_feature (2974)..(2974): n is a, c, g, or t
acatagttatacagtcattacgaatcgtgatattaattatcctcgcttgtggttgtcataattaatcattttgtttgttgtaatttggttcttcagcacaagatatttttcacgtcttacgcaagagagaagaagggggatcggctttttttcccgaaaagaatcaaatcggcggcacagcagtcatgcggtgtcttatatctctcgctgtcgaagcgcttttgctataatagtagagctcgcacccagccgaccgccttcccgtggagtggtgaaaaagaagcgtcggccgctaggaggggcgagcctctcgttgttgactgagagagaagaggggggagcgcgaggctgagagatgggagctgccgctgctagaggagagagatagttctatagagagagtggcgccggcccctctgttttttcttttttgtgttttgatttttttttttttttttttttgtttttcttttttttttttgtttttttttttttttttaattgtgaagtaaaattttgttcctttgcaaattttaataaattattgaagtttattttttgtttcaaataatctgggcttcagttctaataatggaaggacaatgtgaaggcccagaattcagcatagcgcctggcattaataggaggtcagtacatttttagtacatgtttctcaaatagatcttaaaatttcatttaagagcgtttcctcacgtcacagtatgtctctggcgttacttaattttgaaaaacctcaacacagattctagttttaggcaaagctcagaaaatttcttttctacttaaggatatttccaaagcgaaaggaagcgcggagacgttcatgactggcatcatctcgcacgtggttccggaaattctcggtaggatgccctacatctgctctccctccactaagaagaacctctttgtgtggcgaaagtaaaagtattagggcttttaagttgcccagagtcaaggaacacggataaagacgctgggagattgacatgcatttcgaccaatagcattgcagagaggcgtatcatttcgcggatgttccaatcagtacgcagagagtcgccgtctccaaggtgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgctttggtcggcatggccccattcgcacggctctggagcggcggctgcacaaccagtggaggcaagagggcggctttgggcggggtccagttccgggattagcgaacttccaggccctcggtcactgtgacgtcctgctctctctgcgcctgctggagaaccgggccctcggggatgcagctcgttaccacctggtgcagcaactctttcccggcccgggcgtccgggacgccgatgaggagacactccaagagagcctggcccgccttgcccgccggcggtctgcggtgcacatgctgcgcttcaatggctatagagagaacccaaatctccaggaggactctctgatgaagacccaggcggagctgctgctggagcgtctgcaggaggtggggaaggccgaagcggagcgtcccgccaggtttctcagcagcctgtgggagcgcttgcctcagaacaacttcctgaaggtgatagcggtggcgctgttgcagccgcctttgtctcgtcggccccaagaagagttggaacccggcatccacaaatcacctggagaggggagccaagtgctagtccactggcttctggggaattcggaagtctttgctgccttttgtcgcgccctcccagccgggcttttgactttagtgactagccgccacccagcgctgtctcctgtctatctgggtctgctaacagactggggtcaacgtttgcactatgaccttcagaaaggcatttgggttggaactgagtcccaagatgtgccctgggaggagttgcacaataggtttcaaagcctctgtcaggcccctccacctctgaaagataaagttctaactgccctggagacctgtaaagcgcaggatggagattttgaagtacctggtcttagcatctggacagacctcttattagctcttcgtagtggtgcatttaggaaaagacaagttttgggtctcagcgcaggcctcagttctgtataggcaatgctgtgttattacttgaatatagaatatatagtttacaaaatgaaaattacaatgttctcaccaaatatatgccttcgtgtgtccaaagtataattattttagatgctaattttgaatagtttattaaacagttataaatatgcaaagtagctggcatgtagtgtcacggattttctggatagaggaagtgattggaagtattccacttaaagccatggaattagcaatagtttgctttttaatagaaggcccatttgtaagaatgttgaaaatatgtgtaccgtttaaagaaaaagcagctttaaagtgacaaacaaaataccctttttcttttagtatggtttatttttctaggttttctgtccctccctcagtagtgaagagttttctttattcctggcagtgtcaggaatattggtttgaaaagctgttggcctatctggagtttggccttgttaacctagtattctaaccagttaaccagccttagtatgcattaaaattgtattgttcagaaagtttgtttctcattttctgcaaattcttactttgaaaatgaatcaccacatagtatgtccctttaaagcattgacgcacagacaaatgtttaaagcacagtaaatacaaatatatgcctttggatantaaattaatgcttgatgataaaagaatcaaacttttttttttttgagatggagtctcgctctgtcacccagnctggagtgcagtggtgtgatcactgctcagtgcaacctctgcctcccaggatcaagcaattctgactcagcctcccaagtagctgggattacaggtgcaggccaccatgcccggctaattttttgtatttttagtagagacggggtttcaccatgctggccaggctggtctcaaacacctgaccttgtgatccgtccgccttggcctcccaaagtgctgggattacaggcgtgagccaccgcgcctggccaaaacaacattttaagtagaagatccaggttttagtgcagcttctgccgttaactaggttaataaatcacaaccttggggccacagttgccttatatgtaaatgaagtgtttagaataaaatagttaaatttccttatttttcccttggtggctgccctgtggaaacagtttagaatatttgttttgtgtgtaggaacctagttgtgttagtttacctgggtgttccacagctgatagtgattgccttgaataaattcaagggcaatttattcatttttactagggagatagacctttacagcaatcaagatatttttgtccatatccaggttagctggtaagaggatttttttggagaaaaaaaatgatatttagaaagttaatttctaattccggaatggaataaaaacaatatgagtagtgtaatcttgtagaaaaagagttgtataatcttgtagaatttctcattctgtggtacaacccaggggtaaactattattccagtagtcagtacacttttctagataaatcttgagtgaaaaccagcaatttctttttccttgtggtctgattcctttttctaatccatgaaggccatcttgtagattacatttatcattaatgcaagaataaagacaattcctcctgtca

SEQ ID NO: 311317 - DNA, 2401 bp, Homo sapiens
acatagttatacagtcattacgaatcgtgatattaattatcctcgcttgtggttgtcataattaatcattttgtttgttgtaatttggttcttcagcacaagatatttttcacgtcttacgcaagagagaagaagggggatcggctttttttcccgaaaagaatcaaatcggcggcacagcagtcatgcggtgtcttatatctctcgctgtcgaagcgcttttgctataatagtagagctcgcacccagccgaccgccttcccgtggagtggtgaaaaagaagcgtcggccgctaggaggggcgagcctctcgttgttgactgagagagaagaggggggagcgcgaggctgagagatgggagctgccgctgctagaggagagagatagttctatagagagagtggcgccggcccctctgttttttcttttttgtgttttgatttttttttttttttttttttgtttttcttttttttttttgtttttttttttttttttaattgtgaagtaaaattttgttcctttgcaaattttaataaattattgaagtttattttttgtttcaaataatctgggcttcagttctaataatggaaggacaatgtgaaggcccagaattcagcatagcgcctggcattaataggaggtcagtacatttttagtacatgtttctcaaatagatcttaaaatttcatttaagagcgtttcctcacgtcacagtatgtctctggcgttacttaattttgaaaaacctcaacacagattctagttttaggcaaagctcagaaaatttcttttctacttaaggatatttccaaagcgaaaggaagcgcggagacgttcatgactggcatcatctcgcacgtggttccggaaattctcggtaggatgccctacatctgctctccctccactaagaagaacctctttgtgtggcgaaagtaaaagtattagggcttttaagttgcccagagtcaaggaacacggataaagacgctgggagattgacatgcatttcgaccaatagcattgcagagaggcgtatcatttcgcggatgttccaatcagtacgcagagagtcgccgtctccaaggtgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgctttggtcggcatggccccattcgcacggctctggagcggcggctgcacaaccagtggaggcaagagggcggctttgggcggggtccagttccgggattagcgaacttccaggccctcggtcactgtgacgtcctgctctctctgcgcctgctggagaaccgggccctcggggatgcagctcgttaccacctggtgcagcaactctttcccggcccgggcgtccgggacgccgatgaggagacactccaagagagcctggcccgccttgcccgccggcggtctgcggtgcacatgctgcgcttcaatggctatagagagaacccaaatctccaggaggactctctgatgaagacccaggcggagctgctgctggagcgtctgcaggaggtggggaaggccgaagcggagcgtcccgccaggtttctcagcagcctgtgggagcgcttgcctcagaacaacttcctgaaggtgatagcggtggcgctgttgcagccgcctttgtctcgtcggccccaagaagagttggaacccggcatccacaaatcacctggagaggggagccaagtgctagtccactggcttctggggaattcggaagtctttgctgccttttgtcgcgccctcccagccgggcttttgactttagtgactagccgccacccagcgctgtctcctgtctatctgggtctgctaacagactggggtcaacgtttgcactatgaccttcagaaaggcatttgggttggaactgagtcccaagatgtgccctgggaggagttgcacaataggtttcaaagcctctgtcaggcccctccacctctgaaagataaagttctaactgccctggagacctgtaaagcgcaggatggagattttgaagtacctggtcttagcatctggacagacctcttattagctcttcgtagtggtgcatttaggaaaagacaagttttgggtctcagcgcaggcctcagttctgtataggcaatgctgtgttattacttgaatatagaatatatagtttacaaaatgaaaattacaatgttctcaccaaatatatgccttcgtgtgtccaaagtataattattttagatgctaattttgaatagtttattaaacagttataaatatgca

SEQ ID NO: 311318 - DNA, 2319 bp, Homo sapiens
acatagttatacagtcattacgaatcgtgatattaattatcctcgcttgtggttgtcataattaatcattttgtttgttgtaatttggttcttcagcacaagatatttttcacgtcttacgcaagagagaagaagggggatcggctttttttcccgaaaagaatcaaatcggcggcacagcagtcatgcggtgtcttatatctctcgctgtcgaagcgcttttgctataatagtagagctcgcacccagccgaccgccttcccgtggagtggtgaaaaagaagcgtcggccgctaggaggggcgagcctctcgttgttgactgagagagaagaggggggagcgcgaggctgagagatgggagctgccgctgctagaggagagagatagttctatagagagagtggcgccggcccctctgttttttcttttttgtgttttgatttttttttttttttttttttgtttttcttttttttttttgtttttttttttttttttaattgtgaagtaaaattttgttcctttgcaaattttaataaattattgaagtttattttttgtttcaaataatctgggcttcagttctaataatggaaggacaatgtgaaggcccagaattcagcatagcgcctggcattaataggaggtcagtacatttttagtacatgtttctcaaatagatcttaaaatttcatttaagagcgtttcctcacgtcacagtatgtctctggcgttacttaattttgaaaaacctcaacacagattctagttttaggcaaagctcagaaaatttcttttctacttaaggatatttccaaagcgaaaggaagcgcggagacgttcatgactggcatcatctcgcacgtggttccggaaattctcggtaggatgccctacatctgctctccctccactaagaagaacctctttgtgtggcgaaagtaaaagtattagggcttttaagttgcccagagtcaaggaacacggataaagacgctgggagattgacatgcatttcgaccaatagcattgcagagaggcgtatcatttcgcggatgttccaatcagtacgcagagagtcgccgtctccaaggtgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgctttggtcggcatggccccattcgcacggctctggagcggcggctgcacaaccagtggaggcaagagggcggctttgggcggggtccagttccgggattagcgaacttccaggccctcggtcactgtgacgtcctgctctctctgcgcctgctggagaaccgggccctcggggatgcagctcgttaccacctggtgcagcaactctttcccggcccgggcgtccgggacgccgatgaggagacactccaagagagcctggcccgccttgcccgccggcggtctgcggtgcacatgctgcgcttcaatggctatagagagaacccaaatctccaggaggactctctgatgaagacccaggcggagctgctgctggagcgtctgcaggaggtggggaaggccgaagcggagcgtcccgccaggtttctcagcagcctgtgggagcgcttgcctcagaacaacttcctgaaggtgatagcggtggcgctgttgcagccgcctttgtctcgtcggccccaagaagagttggaacccggcatccacaaatcacctggagaggggagccaagtgctagtccactggcttctggggaattcggaagtctttgctgccttttgtcgcgccctcccagccgggcttttgactttagtgactagccgccacccagcgctgtctcctgtctatctgggtctgctaacagactggggtcaacgtttgcactatgaccttcagaaaggcatttgggttggaactgagtcccaagatgtgccctgggaggagttgcacaataggtttcaaagcctctgtcaggcccctccacctctgaaagataaagttctaactgccctggagacctgtaaagcgcaggatggagattttgaagtacctggtcttagcatctggacagacctcttattagctcttcgtagtggtgcatttaggaaaagacaagttttgggtctcagcgcaggcctcagttctgtataggcaatgctgtgttattacttgaatatagaatatatagtttacaaaatgaaaattacaatgttctcacc

SEQ ID NO: 311319 - DNA, 879 bp, Homo sapiens
ggccaagaattgggcacgagggaatttctcattctgtggtacaacccaggggtaaactattattccagtagtcagtacacttttctagataaatcttgagtgaaaaccagcaatttctttttccttgtggtctgattcctttttctaatccatgaaggccatcttgtagattacatttatcattaatgcaagaataaagacaattcctcctgtcagttgcgtgaattttttttaagaaacaacccagtgaagagttctaccatagcaaggcctaatgttagctttagctttagaaaataacagtttgtgaacttacttccctatatttgcagctgtatctcacactatgatttacaataaaattgtaaagattgacaatagacttaagaaataacattttaaaatctattttatacttaccatttattattctgttattttagtctccatatgttcattacatacataatcttatttaatcttcacaccaaaactgtattcttatgaatatacgctaaaagattaagtaaaatgcccaagggtataaacaaaagcaacatgaaagtggaagccgtatctgtcatttattttatttccagaagcctagcacagtgtccagcatatggtagatacttgtagtgtttgaataaatgaaaccagcattagagctttatatactttctcttaaggacttgaaaagattaggaatctacgcatacactgagagagaaaaaagtgagaggaagactataaaaatagaatatttgataacttctttataaaatctagagatatttattttgtgttttttccctatgtcctatcaaatgagggagcactattgaaatctcccattgtaacattgtttcaggaaatttt

SEQ ID NO: 311320 - DNA, 4540 bp, Homo sapiens
  misc_feature (2902)..(2902): n is a, c, g, or t
  misc_feature (2974)..(2974): n is a, c, g, or t
acatagttatacagtcattacgaatcgtgatattaattatcctcgcttgtggttgtcataattaatcattttgtttgttgtaatttggttcttcagcacaagatatttttcacgtcttacgcaagagagaagaagggggatcggctttttttcccgaaaagaatcaaatcggcggcacagcagtcatgcggtgtcttatatctctcgctgtcgaagcgcttttgctataatagtagagctcgcacccagccgaccgccttcccgtggagtggtgaaaaagaagcgtcggccgctaggaggggcgagcctctcgttgttgactgagagagaagaggggggagcgcgaggctgagagatgggagctgccgctgctagaggagagagatagttctatagagagagtggcgccggcccctctgttttttcttttttgtgttttgatttttttttttttttttttttgtttttcttttttttttttgtttttttttttttttttaattgtgaagtaaaattttgttcctttgcaaattttaataaattattgaagtttattttttgtttcaaataatctgggcttcagttctaataatggaaggacaatgtgaaggcccagaattcagcatagcgcctggcattaataggaggtcagtacatttttagtacatgtttctcaaatagatcttaaaatttcatttaagagcgtttcctcacgtcacagtatgtctctggcgttacttaattttgaaaaacctcaacacagattctagttttaggcaaagctcagaaaatttcttttctacttaaggatatttccaaagcgaaaggaagcgcggagacgttcatgactggcatcatctcgcacgtggttccggaaattctcggtaggatgccctacatctgctctccctccactaagaagaacctctttgtgtggcgaaagtaaaagtattagggcttttaagttgcccagagtcaaggaacacggataaagacgctgggagattgacatgcatttcgaccaatagcattgcagagaggcgtatcatttcgcggatgttccaatcagtacgcagagagtcgccgtctccaaggtgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgctttggtcggcatggccccattcgcacggctctggagcggcggctgcacaaccagtggaggcaagagggcggctttgggcggggtccagttccgggattagcgaacttccaggccctcggtcactgtgacgtcctgctctctctgcgcctgctggagaaccgggccctcggggatgcagctcgttaccacctggtgcagcaactctttcccggcccgggcgtccgggacgccgatgaggagacactccaagagagcctggcccgccttgcccgccggcggtctgcggtgcacatgctgcgcttcaatggctatagagagaacccaaatctccaggaggactctctgatgaagacccaggcggagctgctgctggagcgtctgcaggaggtggggaaggccgaagcggagcgtcccgccaggtttctcagcagcctgtgggagcgcttgcctcagaacaacttcctgaaggtgatagcggtggcgctgttgcagccgcctttgtctcgtcggccccaagaagagttggaacccggcatccacaaatcacctggagaggggagccaagtgctagtccactggcttctggggaattcggaagtctttgctgccttttgtcgcgccctcccagccgggcttttgactttagtgactagccgccacccagcgctgtctcctgtctatctgggtctgctaacagactggggtcaacgtttgcactatgaccttcagaaaggcatttgggttggaactgagtcccaagatgtgccctgggaggagttgcacaataggtttcaaagcctctgtcaggcccctccacctctgaaagataaagttctaactgccctggagacctgtaaagcgcaggatggagattttgaagtacctggtcttagcatctggacagacctcttattagctcttcgtagtggtgcatttaggaaaagacaagttttgggtctcagcgcaggcctcagttctgtataggcaatgctgtgttattacttgaatatagaatatatagtttacaaaatgaaaattacaatgttctcaccaaatatatgccttcgtgtgtccaaagtataattattttagatgctaattttgaatagtttattaaacagttataaatatgcaaagtagctggcatgtagtgtcacggattttctggatagaggaagtgattggaagtattccacttaaagccatggaattagcaatagtttgctttttaatagaaggcccatttgtaagaatgttgaaaatatgtgtaccgtttaaagaaaaagcagctttaaagtgacaaacaaaataccctttttcttttagtatggtttatttttctaggttttctgtccctccctcagtagtgaagagttttctttattcctggcagtgtcaggaatattggtttgaaaagctgttggcctatctggagtttggccttgttaacctagtattctaaccagttaaccagccttagtatgcattaaaattgtattgttcagaaagtttgtttctcattttctgcaaattcttactttgaaaatgaatcaccacatagtatgtccctttaaagcattgacgcacagacaaatgtttaaagcacagtaaatacaaatatatgcctttggatantaaattaatgcttgatgataaaagaatcaaacttttttttttttgagatggagtctcgctctgtcacccagnctggagtgcagtggtgtgatcactgctcagtgcaacctctgcctcccaggatcaagcaattctgactcagcctcccaagtagctgggattacaggtgcaggccaccatgcccggctaattttttgtatttttagtagagacggggtttcaccatgctggccaggctggtctcaaacacctgaccttgtgatccgtccgccttggcctcccaaagtgctgggattacaggcgtgagccaccgcgcctggccaaaacaacattttaagtagaagatccaggttttagtgcagcttctgccgttaactaggttaataaatcacaaccttggggccacagttgccttatatgtaaatgaagtgtttagaataaaatagttaaatttccttatttttcccttggtggctgccctgtggaaacagtttagaatatttgttttgtgtgtaggaacctagttgtgttagtttacctgggtgttccacagctgatagtgattgccttgaataaattcaagggcaatttattcatttttactagggagatagacctttacagcaatcaagatatttttgtccatatccaggttagctggtaagaggatttttttggagaaaaaaaatgatatttagaaagttaatttctaattccggaatggaataaaaacaatatgagtagtgtaatcttgtagaaaaagagttgtataatcttgtagaatttctcattctgtggtacaacccaggggtaaactattattccagtagtcagtacacttttctagataaatcttgagtgaaaaccagcaatttctttttccttgtggtctgattcctttttctaatccatgaaggccatcttgtagattacatttatcattaatgcaagaataaagacaattcctcctgtcagttgcgtgaattttttttaagaaacaacccagtgaagagttctaccatagcaaggcctaatgttagctttagctttagaaaataacagtttgtgaacttacttccctatatttgcagctgtatctcacactatgatttacaataaaattgtaaagattgacaatagacttaagaaataacattttaaaatctattttatacttaccatttattattctgttattttagtctccatatgttcattacatacataatcttatttaatcttcacaccaaaactgtattcttatgaatatacgctaaaagattaagtaaaatgcccaagggtataaacaaaagcaacatgaaagtggaagccgtatctgtcatttattttatttccagaagcctagcacagtgtccagcatatggtagatacttgtagtgtttgaataaatgaaaccagcattagagctttatatactttctcttaaggacttgaaaagattaggaatctacgcatacactgagagagaaaaaagtgagaggaagactataaaaatagaatatttgataacttctttataaaatctagagatatttattttgtgttttttccctatgtcctatcaaatgagggagcactattgaaatctcccattgtaacattgtttcaggaaatttt

SEQ ID NO: 311321 - DNA, 4275 bp, Homo sapiens
  misc_feature (2902)..(2902): n is a, c, g, or t
  misc_feature (2974)..(2974): n is a, c, g, or t
acatagttatacagtcattacgaatcgtgatattaattatcctcgcttgtggttgtcataattaatcattttgtttgttgtaatttggttcttcagcacaagatatttttcacgtcttacgcaagagagaagaagggggatcggctttttttcccgaaaagaatcaaatcggcggcacagcagtcatgcggtgtcttatatctctcgctgtcgaagcgcttttgctataatagtagagctcgcacccagccgaccgccttcccgtggagtggtgaaaaagaagcgtcggccgctaggaggggcgagcctctcgttgttgactgagagagaagaggggggagcgcgaggctgagagatgggagctgccgctgctagaggagagagatagttctatagagagagtggcgccggcccctctgttttttcttttttgtgttttgatttttttttttttttttttttgtttttcttttttttttttgtttttttttttttttttaattgtgaagtaaaattttgttcctttgcaaattttaataaattattgaagtttattttttgtttcaaataatctgggcttcagttctaataatggaaggacaatgtgaaggcccagaattcagcatagcgcctggcattaataggaggtcagtacatttttagtacatgtttctcaaatagatcttaaaatttcatttaagagcgtttcctcacgtcacagtatgtctctggcgttacttaattttgaaaaacctcaacacagattctagttttaggcaaagctcagaaaatttcttttctacttaaggatatttccaaagcgaaaggaagcgcggagacgttcatgactggcatcatctcgcacgtggttccggaaattctcggtaggatgccctacatctgctctccctccactaagaagaacctctttgtgtggcgaaagtaaaagtattagggcttttaagttgcccagagtcaaggaacacggataaagacgctgggagattgacatgcatttcgaccaatagcattgcagagaggcgtatcatttcgcggatgttccaatcagtacgcagagagtcgccgtctccaaggtgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgctttggtcggcatggccccattcgcacggctctggagcggcggctgcacaaccagtggaggcaagagggcggctttgggcggggtccagttccgggattagcgaacttccaggccctcggtcactgtgacgtcctgctctctctgcgcctgctggagaaccgggccctcggggatgcagctcgttaccacctggtgcagcaactctttcccggcccgggcgtccgggacgccgatgaggagacactccaagagagcctggcccgccttgcccgccggcggtctgcggtgcacatgctgcgcttcaatggctatagagagaacccaaatctccaggaggactctctgatgaagacccaggcggagctgctgctggagcgtctgcaggaggtggggaaggccgaagcggagcgtcccgccaggtttctcagcagcctgtgggagcgcttgcctcagaacaacttcctgaaggtgatagcggtggcgctgttgcagccgcctttgtctcgtcggccccaagaagagttggaacccggcatccacaaatcacctggagaggggagccaagtgctagtccactggcttctggggaattcggaagtctttgctgccttttgtcgcgccctcccagccgggcttttgactttagtgactagccgccacccagcgctgtctcctgtctatctgggtctgctaacagactggggtcaacgtttgcactatgaccttcagaaaggcatttgggttggaactgagtcccaagatgtgccctgggaggagttgcacaataggtttcaaagcctctgtcaggcccctccacctctgaaagataaagttctaactgccctggagacctgtaaagcgcaggatggagattttgaagtacctggtcttagcatctggacagacctcttattagctcttcgtagtggtgcatttaggaaaagacaagttttgggtctcagcgcaggcctcagttctgtataggcaatgctgtgttattacttgaatatagaatatatagtttacaaaatgaaaattacaatgttctcaccaaatatatgccttcgtgtgtccaaagtataattattttagatgctaattttgaatagtttattaaacagttataaatatgcaaagtagctggcatgtagtgtcacggattttctggatagaggaagtgattggaagtattccacttaaagccatggaattagcaatagtttgctttttaatagaaggcccatttgtaagaatgttgaaaatatgtgtaccgtttaaagaaaaagcagctttaaagtgacaaacaaaataccctttttcttttagtatggtttatttttctaggttttctgtccctccctcagtagtgaagagttttctttattcctggcagtgtcaggaatattggtttgaaaagctgttggcctatctggagtttggccttgttaacctagtattctaaccagttaaccagccttagtatgcattaaaattgtattgttcagaaagtttgtttctcattttctgcaaattcttactttgaaaatgaatcaccacatagtatgtccctttaaagcattgacgcacagacaaatgtttaaagcacagtaaatacaaatatatgcctttggatantaaattaatgcttgatgataaaagaatcaaacttttttttttttgagatggagtctcgctctgtcacccagnctggagtgcagtggtgtgatcactgctcagtgcaacctctgcctcccaggatcaagcaattctgactcagcctcccaagtagctgggattacaggtgcaggccaccatgcccggctaattttttgtatttttagtagagacggggtttcaccatgctggccaggctggtctcaaacacctgaccttgtgatccgtccgccttggcctcccaaagtgctgggattacaggcgtgagccaccgcgcctggccaaaacaacattttaagtagaagatccaggttttagtgcagcttctgccgttaactaggttaataaatcacaaccttggggccacagttgccttatatgtaaatgaagtgtttagaataaaatagttaaatttccttatttttcccttggtggctgccctgtggaaacagtttagaatatttgttttgtgtgtaggaacctagttgtgttagtttacctgggtgttccacagctgatagtgattgccttgaataaattcaagggcaatttattcatttttactagggagatagacctttacagcaatcaagatatttttgtccatatccaggttagctggtaagaggatttttttggagaaaaaaaatgatatttagaaagttaatttctaattccggaatggaataaaaacaatatgagtagtgtaatcttgtagaaaaagagttgtataatcttgtagaatttctcattctgtggtacaacccaggggtaaactattattccagtagtcagtacacttttctagataaatcttgagtgaaaaccagcaatttctttttccttgtggtctgattcctttttctaatccatgaaggccatcttgtagattacatttatcattaatgcaagaataaagacaattcctcctgtcaaaaaaaaaaaaaaaaaaaaaaaaaaaaaaaaaaaaaaaagaaaaaaaaaaaaaaaaaacaaacaaaagaagaaaaacagaaaaacaaccaaaccacaaaacaagaagacaaaaacacaaacgaaaaaagaaaagagggggggggagagcaaagatcaaaacacttcggggagggcgccgccacagtacgatgcctgcaccctatagtgttaaagagaagcggccggccactaaaaacagaggagcgacgactaatcactaacacgacgcggaagggcggcgcaagaacaaaaagcagcgcacaaacgaagaagaagacaccgagaagagagagtacacgattcgaaaagacaccacactctgcggcggggcgcccaactagcgggagcaaacaaccgcg

SEQ ID NO: 311322 - DNA, 287 bp, Homo sapiens
ctgatagggcagtggaaccacctgtctgccttggagatattttcttcacagccctcaccattgcttttaatgacatatttgtgtgtttcttatactagggtctgtcccaccacgttcctgagggtaggacctaggtccctttgtattaattgttctaagaactccatgtttaagaaaccataattagtcagtttgacaaacggcacccccctgcccatttccacatcttcaaaactggaatttggtttataattgatcaggtcttacaactacaattgtttgtattt

SEQ ID NO: 311323 - DNA, 3367 bp, Homo sapiens
gccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttc

SEQ ID NO: 311324 - DNA, 4738 bp, Homo sapiens
agttgagaatcttttaattttcagtgacagaatgaatactttacccatgctggcttaaactaaaaatggacttcattggctgacttcagggagagcttgatctaggagctcagatgttatccctaggactcaatttctctccacctcacagctgtgctttctactgtgttggcttccttttaaggctccaaagctctaggcgagtattcctgcaggtttcgagtccagtagaaaagggacagagtgaattctcttcgaagagtcccaagcaaaagtttctgtgcatttcttaaatctgattaggttacaggacttcttgtgaactggttatatagatgattgctctgatgggccactccagattcagaatagaaacaatccacctgaagcgtgtgaactaaacatggatatgcatggatcccttaaggaattttaggatgataaatttgggatgatggaagacaagggtctagaacgtttttctgttttatgtctagaccgagtgatagtgaggtgtatttactgaataatactttgtgcctagaatattgtaatcttgtaatttttttttaattcaggaaattcagcaaagcagcattttgtattagaagtaatttgtatacttgacatttgaaaaaaatagggcttaagtggaaactgtgtcattaatatttaatttttggaattgatcctgaggtgatcaatttataaataatatatagaattctcatgtttatgatacttgatcagagataattttttgttttatagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaaactaaccaggcacctttgtgccatgtgtgacataggaagagtaacataaaatgaaaacacattcaacaggttgaaaaaaataaggaaacttaaagggcatccaagattaattgttcactatgtgagctgagtgtaggcttgatcttgtgaatattaccacaagaaacattttgtggcactttactgtttgagtaacgttggtgtgaagcttaattgatgccttttgctttatgtcccgcttaagtctgtgtgaaggatttgtgtttttctgccttacaaatagaatttgatttattgggcaggaattcatggatagtaatgctctctgccccctttacttcagaaaacacagtgactttagtgaatttgaatagtgaaactgctctgaaatgctatggaaagccgactccccaaagagtggtttcttctagaagtttgaatttgtagctacagtttccaagaagaaaaatagtagttggataatttagtaaaataataacatcattttcattttcttacctattcttaactttggtttcctaaaggaagaaaatgagcaggtagcacataatctatttaagtagatttaaagagagtttcaaaataaatctcctggtctagctcttaggtgaataaaatagattttgtttgagacctcaaaatattttgaggttagctggtaattttcaataatttacaagcttccttccaaactaatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttttaaaggagaaactttttgactatctgggttagaggaagatatgtgtaccgcctttagggcattttgttatttccgctgaatcattagttattaggatagataaatttttccaattagtttcagcaagcgttgttggaaacactgtgcagtcaaggattgtgcagtgctggttgtgtgaccacaccctgagtcagtggtgtggggaagtaaagtgtgaagaagcagtaagattggtttttaattttgcccatgttttaaattttcctggtgttttcggtagctgactataaaatgatagagacatttgggacaggcactttaaactgaacaccccttttggttttaccaaaggtcttcagtaattgttcttttctttttcctcctggactgcaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaggtgtttagtgtgtgatctttcattgctatgtgaatcagagatgtgatgattttgttcttgaatgtgccaagtctcagataatacagagtagatgacaaattc

SEQ ID NO: 311325 - DNA, 4960 bp, Homo sapiens
gccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagccacagtccccacccttaacccctactagtttattcacatccagtactcctaatgggtcccagtttctcacattctccattgagcccgtgcattattgtatgaatgaaataaaaacagggaagcccagaattccttctttcagaagcctcaaaagaggggtaagtttaataatggggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaaactaaccaggcacctttgtgccatgtgtgacataggaagagtaacataaaatgaaaacacattcaacaggttgaaaaaaataaggaaacttaaagggcatccaagattaattgttcactatgtgagctgagtgtaggcttgatcttgtgaatattaccacaagaaacattttgtggcactttactgtttgagtaacgttggtgtgaagcttaattgatgccttttgctttatgtcccgcttaagtctgtgtgaaggatttgtgtttttctgccttacaaatagaatttgatttattgggcaggaattcatggatagtaatgctctctgccccctttacttcagaaaacacagtgactttagtgaatttgaatagtgaaactgctctgaaatgctatggaaagccgactccccaaagagtggtttcttctagaagtttgaatttgtagctacagtttccaagaagaaaaatagtagttggataatttagtaaaataataacatcattttcattttcttacctattcttaactttggtttcctaaaggaagaaaatgagcaggtagcacataatctatttaagtagatttaaagagagtttcaaaataaatctcctggtctagctcttaggtgaataaaatagattttgtttgagacctcaaaatattttgaggttagctggtaattttcaataatttacaagcttccttccaaactaatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttttaaaggagaaactttttgactatctgggttagaggaagatatgtgtaccgcctttagggcattttgttatttccgctgaatcattagttattaggatagataaatttttccaattagtttcagcaagcgttgttggaaacactgtgcagtcaaggattgtgcagtgctggttgtgtgaccacaccctgagtcagtggtgtggggaagtaaagtgtgaagaagcagtaagattggtttttaattttgcccatgttttaaattttcctggtgttttcggtagctgactataaaatgatagagacatttgggacaggcactttaaactgaacaccccttttggttttaccaaaggtcttcagtaattgttcttttctttttcctcctggactgcaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaggtgtttagtgtgtgatctttcattgctatgtgaatcagagatgtgatgattttgttcttgaatgtgccaagtctcagataatacagagtagatgacaaattc

SEQ ID NO: 311326 - DNA, 3482 bp, Homo sapiens
gccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaggtgtttagtgtgtgatctttcattgctatgtgaatcagagatgtgatgattttgttcttgaatgtgccaagtctcagataatacagagtagatgacaaattc

SEQ ID NO: 311327 - DNA, 664 bp, Homo sapiens
gccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagttaggcgcccagcaactagtagatatcactcatatgccaacagtacagagactgtcaaggtagatcatcggcgatacttcgatgaaaggaacagacgatcacgacaaggatcaaccccggccgatgcaatctacgcatgcatacaggtagaactgaagaggaatcacaaacaggcaaatctaca

SEQ ID NO: 311328 - DNA, 143 bp, Homo sapiens
taacaacagtgtaactatgagggtagaaatatttaatttttgatgggggatcactaattgaactcctttagaatgattgaaaaattcagttttctctttttaaaaaaattcttgattattagcaactacaagaaatggacgaa

SEQ ID NO: 311329 - DNA, 4785 bp, Homo sapiens
gccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggtgcagtaacttatatctaaactaaccaggcacctttgtgccatgtgtgacataggaagagtaacataaaatgaaaacacattcaacaggttgaaaaaaataaggaaacttaaagggcatccaagattaattgttcactatgtgagctgagtgtaggcttgatcttgtgaatattaccacaagaaacattttgtggcactttactgtttgagtaacgttggtgtgaagcttaattgatgccttttgctttatgtcccgcttaagtctgtgtgaaggatttgtgtttttctgccttacaaatagaatttgatttattgggcaggaattcatggatagtaatgctctctgccccctttacttcagaaaacacagtgactttagtgaatttgaatagtgaaactgctctgaaatgctatggaaagccgactccccaaagagtggtttcttctagaagtttgaatttgtagctacagtttccaagaagaaaaatagtagttggataatttagtaaaataataacatcattttcattttcttacctattcttaactttggtttcctaaaggaagaaaatgagcaggtagcacataatctatttaagtagatttaaagagagtttcaaaataaatctcctggtctagctcttaggtgaataaaatagattttgtttgagacctcaaaatattttgaggttagctggtaattttcaataatttacaagcttccttccaaactaatctcatacttttgtatgtttcatcttgaaaatatcttttgggaaataccactttagtgattatttagcatttagcagttacacataggaaaatacacagttacatagaaaaatacacatttgaagatagaggaaaccttgaatggaggggaagtgttgacaaattttaatttttaaaggagaaactttttgactatctgggttagaggaagatatgtgtaccgcctttagggcattttgttatttccgctgaatcattagttattaggatagataaatttttccaattagtttcagcaagcgttgttggaaacactgtgcagtcaaggattgtgcagtgctggttgtgtgaccacaccctgagtcagtggtgtggggaagtaaagtgtgaagaagcagtaagattggtttttaattttgcccatgttttaaattttcctggtgttttcggtagctgactataaaatgatagagacatttgggacaggcactttaaactgaacaccccttttggttttaccaaaggtcttcagtaattgttcttttctttttcctcctggactgcaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccaagtccattttaatttcctcagtggttttatgagaagttttatgggcctcccccaattgtctttttattttgggttatgacgatcatgtttgataattacaatgatagtctctttccacgtgatgcttttgtttgaacctgataaaatttagtgaaactttgtaatgatctatgtgcacttttacttgtaaaatggaatttctgtatgtttatacttgtaaatatgattgttgttagtgctcctgttgctcatggtgtcctgcctcgcatttgtgattctgttaatgacatgtatcttaactaatttcttagtggtgttgtaatagggagatggggcaggtggggggttatttgtaccactgaatcttcattaatttggttctttactgttttgaggggagaaagaacgtgaaatggtttgtgtattattgaattttaagcaatattttagaagctgtgtgactgctttaataactttttcccagtgttatttgaatcatactacccgttatactaaagctgaatgacaattgtgtgaaagttactgccttcataagatcaagtcaccactgttacacagctgacatatagtgtattacctttgcagctagtaaactataaagtttagatattgaatctcgttacagggttatttatataatgtgacattattcagtactgacagactacatgaagtagttttaaaatctagtgctatttttattttaaaggttagcaatgaggaggaaatgtgatctggctgtgtttgtcttctgtacaaagcctgaagtgcttatggttttttggctaacagccacagagggcaaagtttaagactttcttgtaaggactaactgttcttttcaagctactgtttgtttttctaaaagcaggatttgcttccgtaggaggcaagttccttgatgtggaatagtgcaacctgtatatgggttattataataggaaagacatttgtacttgcacagtttaaatcattcttaaattttgaacatgtgaattgtcccaaaaaatctttaattttttggtaatttttactctttttgtgcacatgttgatttcttaatggtaaatccttcatttaaagatagtgttctctgttgagaatatttacatggaataaaacaatcttttcatggcctgttaaggtgtttagtgtgtgatctttcattgctatgtgaatcagagatgtgatgattttgttcttgaatgtgccaagtctcagataatacagagtagatgacaaattc

SEQ ID NO: 311330 - DNA, 2344 bp, Homo sapiens
gccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaagtcctgagggaagttacactgatgatgcaaaccaggaagtccgtgggccaccccagcagcatggtcaccacaatgagtttgatgatgaatttgaggatgatgatcccttgcctgctattggacactgcaaagctatctacccttttgatggacataatgaaggtactctagcaatgaaagaaggtgaagttctctacattatagaggaggacaaaggtgacggatggacaagagctcggagacagaacggtgaagaaggctacgttcccacgtcatacatagatgtaactctagagaaaaacagtaaaggttcctgaagagggtttctgaggaaatgggcaagatgttgaaggaggttacatgcagctgcttttgggggagggtattagagttgtcaggctcaaagagagtgagagaagcaagttgcatgagtgcatgcagacatgattttttttttactaacttcattagcatttccatacattgtttttaaaaatcataataccaacccttaagttcctagttcacagttattcccacaaaagaaaaagccaacaatagtgtaccatttttctatttattttattgctgtctaatcaataaagaatgcagagctgtcaaaaaatgtgtcttacattagctgtcccaacaggattgtcttccctcccagctctgttttaattggcttttagacccactatctgtcagatccttgccatctgtcagtgtctgcctgcgccacctccgtgcttgcttaacatcctgttgcatgtctagcgtgattgagctagatttttcaggcatgtctttagattcccttgttcttgtcaaagccttgttttgttttacatttgtagtgcaaatcactttgtcaaacatctccagcactaatgtttccatcttagtatttgtgcacactgctataacttccccactgcaaacattccagttttggcattacgaagaagtagctgtgaacctgaagtatttatgataagaaaaagaaaacatctctgctgtagcctacagcccagttgaaagaactctttgaaacgtgatacatcttcagcacctcagtctgggaagaatctagtcagcactgaaatcctggcataataaacacagaagatattcaccacctcaagacaaaggactattgtcaaaagtcagctgcttccattcaaatgctgccttaaacttgagtgcctaaatctgttgattgccaacactaccactacagtatcccacaaagggctttatgtgtcagctcagtgcgacctgctttaactctgcagcaccgctgcagctgccgatgtagcctcggtaggtggctattagagctctaccatatacagtggtgcatcttcaaatttatgcatcaaactaaagacatgtccatgccatgccatttagtaagtaatcacttcatcatcaccgtcaccatccttaccatcaccatcattgccatgccatttagtaaataatccttcatcaccaccgtcatcatccttaccatcgccatcattg

SEQ ID NO: 311331 - DNA, 1117 bp, Homo sapiens
gccaaacagcagttgaatctgcgtacgcatatggccgatgaaaataaaaatgaatatgctgcacaattacaaaactttaatggagaacaacataaacatttttatgtagtgattcctcagatttacaagcaactacaagaaatggacgaacgaaggactattaaactcagtgagtgttacagaggatttgctgactcagaacgcaaagttattcccatcatttcaaaatgtttggaaggaatgattcttgcagcaaaatcagttgatgaaagaagagactctcaaatggtggtagactccttcaaatctggttttgaacctccaggagactttccatttgaagattacagtcaacatatatatagaaccatttctgatgggactatcagtgcatccaaacaggagagtgggaagatggatgccaaaaccacagtaggaaaggccaagggcaaattgtggctctttggaaagaagccaaagggcccagcactagaagatttcagtcatctgccaccagaacagagacgtaaaaaactacagcagcgcattgatgaacttaacagagaactacagaaagaatcagaccaaaaagatgcactcaacaaaatgaaagatgtatatgagaagaatccacaaatgggggatccagggagtttgcagcctaaattagcagagaccatgaataacattgaccgcctacgaatggaaatccataagaatgaggcttggctctctgaagtcgaaggcaaaacaggtgggagaggagacagaagacatagcagtgacataaatcatcttgtaacacagggacgagaaaggtgattttttgtattttatttgtatttcttctccccagagttttctcacccttttgtcctaaactttatacaattcgtttttttcttccaaatttaacaagttaagcttttagtaacctcagtcttttgaacctaagtaattttctttagtgataattacaggtgaagtaggaaagttcatcttgctattcaatcctagtttgtcatgcatccaaacacagagctaggaacatagaaaattcttggagctacagtctgagggcctaggctcctcgggcatgggaaggtttcctaaggtt

SEQ ID NO: 311332 - DNA, 3721 bp, Homo sapiens
ctccaaagggacggttttctagagctccgacgcctctcggtgcccctctgctccggcccttgccctttgacctcgctctcgcggcagggtgagaggtcgggtggccatcttgtggcggcggcgcgggcggctgttactgcggagacccatcccctcccccttctcgcacccctggcagtctgtcagtcggtaaaaagtcccgcagcctgtcaggtgaggccccggcctcgtgccgtcgctcttcccgccgcactgggcggcccaggccgctccctgccgggcctcactgccgccaccatgtcctccttctctgagtcggcgctggagaagaagctctcggagctgagcaactctcagcagagcgtgcagaccctgtccctttggctcatccaccaccgcaagcacgcgggacccatcgtctccgtgtggcaccgcgagctccgcaaagccaaatcaaatagaaagcttacttttctgtatttagcgaatgatgtcatccaaaacagtaaaaggaaaggacctgaattcactagagaatttgaatctgtccttgtggatgctttttctcatgttgccagagaggcagatgaaggctgtaaaaaacctttagaaagattgctgaacatctggcaagaacgaagtgtgtatggcggcgagttcatacagcagctgaagctgtctatggaggactccaagagccctccccccaaagcaacagaagagaagaaatctctgaaacgaacttttcagcaaattcaggaggaggaggatgacgactaccctggcagctactctcctcaggatccttctgcaggacccctcttgactgaggaactaatcaaagctttgcaggatctggaaaatgccgcatcaggggatgctactgtccgacagaaaattgcttctctgccccaggaagtgcaagatgtttctctattggaaaaaataacagacaaagaggcagctgaacgtctttcaaaaacagtagatgaagcatgtctgttactagcagaatataacgggcgcctggcagcagaactggaggaccgtcgccagctggctcggatgttggtggagtatacccagaatcagaaagatgttttgtcggagaaggagaaaaaactagaggaatacaaacagaagcttgcacgagtaacccaggtccgcaaggaactgaaatcccatattcagagcttgccagacctctcactgctgcccaacgtcacagggggcttagcccccctgccctctgctggggacctgttttcaactgactaggatgggtgtcatgtcccagatttctgtttgtaccagcagaaagaagagggcaagtcatggttggaaataaccttctagcccctggttctatcccttcttccgcccagccccccagcctcaagaaagaacctcagactctgattctcctcttcagcctctcatcttgagcacagttcagaacagtggcgactggaatctggtttatattcatatttgcaaagactacagactttttctcccacttcatattttcatgcccccctgttggttttccattcttaactgtctccttatacctaagaagttatgaaaatcatgtgtacttctggaagctttcgaaagaatcttgtccctcatgacagcattttatcatgaaagcagcttctcctttctgggctgggcttgttcaagttcggtgtgggcttccactaaggcacttgtcctggagacgttggctttcccagctgcatctgccccaaaaggttgtaggcacagctgtcgtagcgttgccataaagagtttgccaaatctctgatcctccctttccattgcttctcctagtgatgcacgaagattaggtgcatttattttgtaaacagattggagaatctagcaataagattcaaagctaatctggagcataaaggcacagttcagagacagaataacagggatcacaagcatgaattaaaaggaatttatttgcttcaagttcctagatacaaccttcccatgctgcacttctccactgtcggagcacgttccgaaaaacagaatgccttgatccctggtgggtgcgaaggcagttgttagggatggcaggcattggtgggctccaaaagatgaaggccccacacacaggtgtgctgcatttgggatctgtgtgggtgtttcttggaccctttcttctgggagtagggtacacactaacgtttaatccgctgtctgggtgcatgtccacagtacggtggctaaactcgaacatcactgcaaataggacgctgagcaggtccgtctgtcatgtcacgccactgcacaggtccttgtccccacacgacggggagtacttgcgtcagatgttattgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataacctatgtttataaagcataacgggcttcccttccagaagctctcctgcttgtcatgaagtgagaacaatgactgttattcagatttgaattcagactgtgtgttgtttgcttatggacactgcctgtcgttctgtcactgttaaattaatgagtctataaggtttttcttccagaggccataggtgacatcactaaaattgcaagataaattgtaatctttgctgctgctgcactccccaacctctcccccaccccccgtggtgtgctgctttctagatgagcgtgttttggagcaggcccatctgggacactctatgctttcaccaaggaagtgcgatctgagcagccacaatccagccaaaagaggatcgtagatatttgctctgatcaactagatgaaaatatagcagaatggatttagcccactgctctgttttatccaactgagtctctgaccagcaattggtgcataattattacagcaaaagttaagaaatgaaactgtagcaattatgtaaatgaatgtgttggcctcttaatacctgttactagtggacttcctgtgaggaagttagttttttgttttgatgaaatgctttcgttttttaaatcttaattctgctgtccacatcctcccaaagtgtgcttacttcatttgtttaatttaaatgaactttcctccttgtatgtatgaggtgacttggtgggtggggtgggtggtttttgtttttgtgttttttctttcttagggcatctgtaggcctcaaaggacctttcctttaggtcatattcctcagaaagtcttcaatcttcccttgtttttgtttgtttgtttttcttaaagaatattttcaaagcttaaatttgtatattaatttaggactatttagaagtataggctgtcgttggcggcagcagtatattctgaaatgtctcatagatatatatttttgaataaagatggtgttgttgaacaaaaaaaaat

SEQ ID NO: 311333 - DNA, 2403 bp, Homo sapiens
gaggctggggggctggacggaagaagggaaagaacctcagactctgattctcctcttcagcctctcatcttgagcacagttcagaacagtggcgactggaatctggtttatattcatatttgcaaagactacagactttttctcccacttcatattttcatgcccccctgttggttttccattcttaactgtctccttatacctaagaagttatgaaaatcatgtgtacttctggaagctttcgaaagaatcttgtccctcatgacagcattttatcatgaaagcagcttctcctttctgggctgggcttgttcaagttcggtgtgggcttccactaaggcacttgtcctggagacgttggctttcccagctgcatctgccccaaaaggttgtaggcacagctgtcgtagcgttgccataaagagtttgccaaatctctgatcctccctttccattgcttctcctagtgatgcacgaagattaggtgcatttattttgtaaacagattggagaatctagcaataagattcaaagctaatctggagcataaaggcacagttcagagacagaataacagggatcacaagcatgaattaaaaggaatttatttgcttcaagttcctagatacaaccttcccatgctgcacttctccactgtcggagcacgttccgaaaaacagaatgccttgatccctggtgggtgcgaaggcagttgttagggatggcaggcattggtgggctccaaaagatgaaggccccacacacaggtgtgctgcatttgggatctgtgtgggtgtttcttggaccctttcttctgggagtagggtacacactaacgtttaatccgctgtctgggtgcatgtccacagtacggtggctaaactcgaacatcactgcaaataggacgctgagcaggtccgtctgtcatgtcacgccactgcacaggtccttgtccccacacgacggggagtacttgcgtcagatgttattgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataacctatgtttataaagcataacgggcttcccttccagaagctctcctgcttgtcatgaagtgagaacaatgaaaagtcatagcagatactcagtttaactctgtgtagaacctagtagtgtttgagctgttattcagatttgaattcagactgtgtgttgtttgcttatggacactgcctgtcgttctgtcactgttaaattaatgagtctataaggtttttcttccagaggccataggtgacatcactaaaattgcaagataaattgtaatctttgctgctgctgcactccccaacctctcccccaccccccgtggtgtgctgctttctagatgagcgtgttttggagcaggcccatctgggacactctatgctttcaccaaggaagtgcgatctgagcagccacaatccagccaaaagaggatcgtagatatttgctctgatcaactagatgaaaatatagcagaatggatttagcccactgctctgttttatccaactgagtctctgaccagcaattggtgcataattattacagcaaaagttaagaaatgaaactgtagcaattatgtaaatgaatgtgttggcctcttaatacctgttactagtggacttcctgtgaggaagttagttttttgttttgatgaaatgctttcgttttttaaatcttaattctgctgtccacatcctcccaaagtgtgcttacttcatttgtttaatttaaatgaactttcctccttgtatgtatgaggtgacttggtgggtggggtgggtggtttttgtttttgtgttttttctttcttagggcatctgtaggcctcaaaggacctttcctttaggtcatattcctcagaaagtcttcaatcttcccttgtttttgtttgtttgtttttcttaaagaatattttcaaagcttaaatttgtatattaatttaggactatttagaagtataggctgtcgttggcggcagcagtatattctgaaatgtctcatagatatatatttttgaataaagatggtgttgttgaacaaaaaaaaat

SEQ ID NO: 311334 - DNA, 1560 bp, Homo sapiens
ctccaaagggacggttttctagagctccgacgcctctcggtgcccctctgctccggcccttgccctttgacctcgctctcgcggcagggtgagaggtcgggtggccatcttgtggcggcggcgcgggcggctgttactgcggagacccatcccctcccccttctcgcacccctggcagtctgtcagtcggtaaaaagtcccgcagcctgtcaggtgaggccccggcctcgtgccgtcgctcttcccgccgcactgggcggcccaggccgctccctgccgggcctcactgccgccaccatgtcctccttctctgagtcggcgctggagaagaagctctcggagctgagcaactctcagcagagcgtgcagaccctgtccctttggctcatccaccaccgcaagcacgcgggacccatcgtctccgtgtggcaccgcgagctccgcaaagccaaatcaaatagaaagcttacttttctgtatttagcgaatgatgtcatccaaaacagtaaaaggaaaggacctgaattcactagagaatttgaatctgtccttgtggatgctttttctcatgttgccagagaggcagatgaaggctgtaaaaaacctttagaaagattgctgaacatctggcaagaacgaagtgtgtatggcggcgagttcatacagcagctgaagctgtctatggaggactccaagagccctccccccaaagcaacagaagagaagaaatctctgaaacgaacttttcagcaaattcaggaggaggaggatgacgactaccctggcagctactctcctcaggatccttctgcaggacccctcttgactgaggaactaatcaaagctttgcaggatctggaaaatgccgcatcaggggatgctactgtccgacagaaaattgcttctctgccccaggaagtgcaagatgtttctctattggaaaaaataacagacaaagaggcagctgaacgtctttcaaaaacagtagatgaagcatgtctgttactagcagaatataacgggcgcctggcagcagaactggaggaccgtcgccagctggctcggatgttggtggagtatacccagaatcagaaagatgttttgtcggagaaggagaaaaaactagagggtgtcatgattgactttggcctatgatgttggcccttaaacaccaggcaagggtggaaggaatgctgctgaaaatctgtgggtaatgtttttgtcatgaacatgagaaaacctagaaatggagaaggcacgtggaaggaagcacaaatggcagcccaaagaggaggttagagaatgtggagggtatagaagaaagcccattcagaaaggcaaaggccaaagataccagaaaagccttccagcttcacttccagagcaaagagaagctttgtttgtggttgacagaggtgactacattactcccagatgtctgctcaaagctcataagacatagcgtgagtgggttggatagggttcctgtcttgtcagcgtgaataaagcatgatacagacatgttctgttagcatgatcagtgcatgtggaagagtgtgt

SEQ ID NO: 311335 - DNA, 719 bp, Homo sapiens
ttgtgagtatctgtaatagagcaacaaatttcaatataagtcaacaaatttcaatacgagctcataaggctttatcttattttttattttccgtagtgttttcttcatgcccccaaaatatttctacccatgaactgggtggtaaatctctgaaaaacaaattttttttgacaaagtaaattttgaaaagatttttttttcttttttttttttttttgtctcaggaagaaagaaatcttgcatcacaatctttcttgctggaataaactgaagtagtctcacctatcaggttttccagcttcaaatctcagatataactaatcattttttcccttctttgcttttctagcaaacttccagaaacaaaacctcgtgccgaattcggcacgaggtttaatttaaatgaactttcctccttgtatgtatgaggtgacttggtgggtggggtgggtggtttttgtttttgtgttttttctttcttagggcatctgtaggcctcaaaggacctttcctttaggtcatattcctcagaaagtcttcaatcttcccttgtttttgtttgtttgtttttcttaaagaatattttcaaagcttaaatttgtatattaatttaggactatttagaagtataggctgtcgttggcggcagcagtatattctgaaatgtctcatagatatatatttttgaataaagatggtgttgttgaacaaaaaaaaat

SEQ ID NO: 311336 - DNA, 3775 bp, Homo sapiens
ctccaaagggacggttttctagagctccgacgcctctcggtgcccctctgctccggcccttgccctttgacctcgctctcgcggcagggtgagaggtcgggtggccatcttgtggcggcggcgcgggcggctgttactgcggagacccatcccctcccccttctcgcacccctggcagtctgtcagtcggtaaaaagtcccgcagcctgtcaggtgaggccccggcctcgtgccgtcgctcttcccgccgcactgggcggcccaggccgctccctgccgggcctcactgccgccaccatgtcctccttctctgagtcggcgctggagaagaagctctcggagctgagcaactctcagcagagcgtgcagaccctgtccctttggctcatccaccaccgcaagcacgcgggacccatcgtctccgtgtggcaccgcgagctccgcaaagccaaatcaaatagaaagcttacttttctgtatttagcgaatgatgtcatccaaaacagtaaaaggaaaggacctgaattcactagagaatttgaatctgtccttgtggatgctttttctcatgttgccagagaggcagatgaaggctgtaaaaaacctttagaaagattgctgaacatctggcaagaacgaagtgtgtatggcggcgagttcatacagcagctgaagctgtctatggaggactccaagagccctccccccaaagcaacagaagagaagaaatctctgaaacgaacttttcagcaaattcaggaggaggaggatgacgactaccctggcagctactctcctcaggatccttctgcaggacccctcttgactgaggaactaatcaaagctttgcaggatctggaaaatgccgcatcaggggatgctactgtccgacagaaaattgcttctctgccccaggaagtgcaagatgtttctctattggaaaaaataacagacaaagaggcagctgaacgtctttcaaaaacagtagatgaagcatgtctgttactagcagaatataacgggcgcctggcagcagaactggaggaccgtcgccagctggctcggatgttggtggagtatacccagaatcagaaagatgttttgtcggagaaggagaaaaaactagaggaatacaaacagaagcttgcacgagtaacccaggtccgcaaggaactgaaatcccatattcagagcttgccagacctctcactgctgcccaacgtcacagggggcttagcccccctgccctctgctggggacctgttttcaactgactaggatgggtgtcatgtcccagatttctgtttgtaccagcagaaagaagagggcaagtcatggttggaaataaccttctagcccctggttctatcccttcttccgcccagccccccagcctcaagaaagaacctcagactctgattctcctcttcagcctctcatcttgagcacagttcagaacagtggcgactggaatctggtttatattcatatttgcaaagactacagactttttctcccacttcatattttcatgcccccctgttggttttccattcttaactgtctccttatacctaagaagttatgaaaatcatgtgtacttctggaagctttcgaaagaatcttgtccctcatgacagcattttatcatgaaagcagcttctcctttctgggctgggcttgttcaagttcggtgtgggcttccactaaggcacttgtcctggagacgttggctttcccagctgcatctgccccaaaaggttgtaggcacagctgtcgtagcgttgccataaagagtttgccaaatctctgatcctccctttccattgcttctcctagtgatgcacgaagattaggtgcatttattttgtaaacagattggagaatctagcaataagattcaaagctaatctggagcataaaggcacagttcagagacagaataacagggatcacaagcatgaattaaaaggaatttatttgcttcaagttcctagatacaaccttcccatgctgcacttctccactgtcggagcacgttccgaaaaacagaatgccttgatccctggtgggtgcgaaggcagttgttagggatggcaggcattggtgggctccaaaagatgaaggccccacacacaggtgtgctgcatttgggatctgtgtgggtgtttcttggaccctttcttctgggagtagggtacacactaacgtttaatccgctgtctgggtgcatgtccacagtacggtggctaaactcgaacatcactgcaaataggacgctgagcaggtccgtctgtcatgtcacgccactgcacaggtccttgtccccacacgacggggagtacttgcgtcagatgttattgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataacctatgtttataaagcataacgggcttcccttccagaagctctcctgcttgtcatgaagtgagaacaatgaaaagtcatagcagatactcagtttaactctgtgtagaacctagtagtgtttgagctgttattcagatttgaattcagactgtgtgttgtttgcttatggacactgcctgtcgttctgtcactgttaaattaatgagtctataaggtttttcttccagaggccataggtgacatcactaaaattgcaagataaattgtaatctttgctgctgctgcactccccaacctctcccccaccccccgtggtgtgctgctttctagatgagcgtgttttggagcaggcccatctgggacactctatgctttcaccaaggaagtgcgatctgagcagccacaatccagccaaaagaggatcgtagatatttgctctgatcaactagatgaaaatatagcagaatggatttagcccactgctctgttttatccaactgagtctctgaccagcaattggtgcataattattacagcaaaagttaagaaatgaaactgtagcaattatgtaaatgaatgtgttggcctcttaatacctgttactagtggacttcctgtgaggaagttagttttttgttttgatgaaatgctttcgttttttaaatcttaattctgctgtccacatcctcccaaagtgtgcttacttcatttgtttaatttaaatgaactttcctccttgtatgtatgaggtgacttggtgggtggggtgggtggtttttgtttttgtgttttttctttcttagggcatctgtaggcctcaaaggacctttcctttaggtcatattcctcagaaagtcttcaatcttcccttgtttttgtttgtttgtttttcttaaagaatattttcaaagcttaaatttgtatattaatttaggactatttagaagtataggctgtcgttggcggcagcagtatattctgaaatgtctcatagatatatatttttgaataaagatggtgttgttgaacaaaaaaaaat

SEQ ID NO: 311337 - DNA, 3721 bp, Homo sapiens
ctccaaagggacggttttctagagctccgacgcctctcggtgcccctctgctccggcccttgccctttgacctcgctctcgcggcagggtgagaggtcgggtggccatcttgtggcggcggcgcgggcggctgttactgcggagacccatcccctcccccttctcgcacccctggcagtctgtcagtcggtaaaaagtcccgcagcctgtcaggtgaggccccggcctcgtgccgtcgctcttcccgccgcactgggcggcccaggccgctccctgccgggcctcactgccgccaccatgtcctccttctctgagtcggcgctggagaagaagctctcggagctgagcaactctcagcagagcgtgcagaccctgtccctttggctcatccaccaccgcaagcacgcgggacccatcgtctccgtgtggcaccgcgagctccgcaaagccaaatcaaatagaaagcttacttttctgtatttagcgaatgatgtcatccaaaacagtaaaaggaaaggacctgaattcactagagaatttgaatctgtccttgtggatgctttttctcatgttgccagagaggcagatgaaggctgtaaaaaacctttagaaagattgctgaacatctggcaagaacgaagtgtgtatggcggcgagttcatacagcagctgaagctgtctatggaggactccaagagccctccccccaaagcaacagaagagaagaaatctctgaaacgaacttttcagcaaattcaggaggaggaggatgacgactaccctggcagctactctcctcaggatccttctgcaggacccctcttgactgaggaactaatcaaagctttgcaggatctggaaaatgccgcatcaggggatgctactgtccgacagaaaattgcttctctgccccaggaagtgcaagatgtttctctattggaaaaaataacagacaaagaggcagctgaacgtctttcaaaaacagtagatgaagcatgtctgttactagcagaatataacgggcgcctggcagcagaactggaggaccgtcgccagctggctcggatgttggtggagtatacccagaatcagaaagatgttttgtcggagaaggagaaaaaactagaggaatacaaacagaagcttgcacgagtaacccaggtccgcaaggaactgaaatcccatattcagagcttgccagacctctcactgctgcccaacgtcacagggggcttagcccccctgccctctgctggggacctgttttcaactgactaggatgggtgtcatgtcccagatttctgtttgtaccagcagaaagaagagggcaagtcatggttggaaataaccttctagcccctggttctatcccttcttccgcccagccccccagcctcaagaaagaacctcagactctgattctcctcttcagcctctcatcttgagcacagttcagaacagtggcgactggaatctggtttatattcatatttgcaaagactacagactttttctcccacttcatattttcatgcccccctgttggttttccattcttaactgtctccttatacctaagaagttatgaaaatcatgtgtacttctggaagctttcgaaagaatcttgtccctcatgacagcattttatcatgaaagcagcttctcctttctgggctgggcttgttcaagttcggtgtgggcttccactaaggcacttgtcctggagacgttggctttcccagctgcatctgccccaaaaggttgtaggcacagctgtcgtagcgttgccataaagagtttgccaaatctctgatcctccctttccattgcttctcctagtgatgcacgaagattaggtgcatttattttgtaaacagattggagaatctagcaataagattcaaagctaatctggagcataaaggcacagttcagagacagaataacagggatcacaagcatgaattaaaaggaatttatttgcttcaagttcctagatacaaccttcccatgctgcacttctccactgtcggagcacgttccgaaaaacagaatgccttgatccctggtgggtgcgaaggcagttgttagggatggcaggcattggtgggctccttcttggaccctttcttctgggagtagggtacacactaacgtttaatccgctgtctgggtgcatgtccacagtacggtggctaaactcgaacatcactgcaaataggacgctgagcaggtccgtctgtcatgtcacgccactgcacaggtccttgtccccacacgacggggagtacttgcgtcagatgttattgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataacctatgtttataaagcataacgggcttcccttccagaagctctcctgcttgtcatgaagtgagaacaatgaaaagtcatagcagatactcagtttaactctgtgtagaacctagtagtgtttgagctgttattcagatttgaattcagactgtgtgttgtttgcttatggacactgcctgtcgttctgtcactgttaaattaatgagtctataaggtttttcttccagaggccataggtgacatcactaaaattgcaagataaattgtaatctttgctgctgctgcactccccaacctctcccccaccccccgtggtgtgctgctttctagatgagcgtgttttggagcaggcccatctgggacactctatgctttcaccaaggaagtgcgatctgagcagccacaatccagccaaaagaggatcgtagatatttgctctgatcaactagatgaaaatatagcagaatggatttagcccactgctctgttttatccaactgagtctctgaccagcaattggtgcataattattacagcaaaagttaagaaatgaaactgtagcaattatgtaaatgaatgtgttggcctcttaatacctgttactagtggacttcctgtgaggaagttagttttttgttttgatgaaatgctttcgttttttaaatcttaattctgctgtccacatcctcccaaagtgtgcttacttcatttgtttaatttaaatgaactttcctccttgtatgtatgaggtgacttggtgggtggggtgggtggtttttgtttttgtgttttttctttcttagggcatctgtaggcctcaaaggacctttcctttaggtcatattcctcagaaagtcttcaatcttcccttgtttttgtttgtttgtttttcttaaagaatattttcaaagcttaaatttgtatattaatttaggactatttagaagtataggctgtcgttggcggcagcagtatattctgaaatgtctcatagatatatatttttgaataaagatggtgttgttgaacaaaaaaaaat

SEQ ID NO: 311338 - DNA, 3720 bp, Homo sapiens
ctccaaagggacggttttctagagctccgacgcctctcggtgcccctctgctccggcccttgccctttgacctcgctctcgcggcagggtgagaggtcgggtggccatcttgtggcggcggcgcgggcggctgttactgcggagacccatcccctcccccttctcgcacccctggcagtctgtcagtcggtaaaaagtcccgcagcctgtcaggtgaggccccggcctcgtgccgtcgctcttcccgccgcactgggcggcccaggccgctccctgccgggcctcactgccgccaccatgtcctccttctctgagtcggcgctggagaagaagctctcggagctgagcaactctcagcagagcgtgcagaccctgtccctttggctcatccaccaccgcaagcacgcgggacccatcgtctccgtgtggcaccgcgagctccgcaaagccaaatcaaatagaaagcttacttttctgtatttagcgaatgatgtcatccaaaacagtaaaaggaaaggacctgaattcactagagaatttgaatctgtccttgtggatgctttttctcatgttgccagagaggcagatgaaggctgtaaaaaacctttagaaagattgctgaacatctggcaagaacgaagtgtgtatggcggcgagttcatacagcagctgaagctgtctatggaggactccaagagccctccccccaaagcaacagaagagaagaaatctctgaaacgaacttttcagcaaattcaggaggaggaggatgacgactaccctggcagctactctcctcaggatccttctgcaggacccctcttgactgaggaactaatcaaagctttgcaggatctggaaaatgccgcatcaggggatgctactgtccgacagaaaattgcttctctgccccaggaagtgcaagatgtttctctattggaaaaaataacagacaaagaggcagctgaacgtctttcaaaaacagtagatgaagcatgtctgttactagcagaatataacgggcgcctggcagcagaactggaggaccgtcgccagctggctcggatgttggtggagtatacccagaatcagaaagatgttttgtcggagaaggagaaaaaactagaggaatacaaacagaagcttgcacgagtaacccaggtccgcaaggaactgaaatcccatattcagagcttgccagacctctcactgctgcccaacgtcacagggggcttagcccccctgccctctgctggggacctgttttcaactgactaggatgggtgtcatgtcccagatttctgtttgtaccagcagaaagaagagggcaagtcatggttggaaataaccttctagcccctggttctatcccttcttccgcccagccccccagcctcaagaaagaacctcagactctgattctcctcttcagcctctcatcttgagcacagttcagaacagtggcgactggaatctggtttatattcatatttgcaaagactacagactttttctcccacttcatattttcatgcccccctgttggttttccattcttaactgtctccttatacctaagaagttatgaaaatcatgtgtacttctggaagctttcgaaagaatcttgtccctcatgacagcattttatcatgaaagcagcttctcctttctgggctgggcttgttcaagttcggtgtgggcttccactaaggcacttgtcctggagacgttggctttcccagctgcatctgccccaaaaggttgtaggcacagctgtcgtagcgttgccataaagagtttgccaaatctctgatcctccctttccattgcttctcctagtgatgcacgaagattaggtgcatttattttgtaaacagattggagaatctagcaataagattcaaagctaatctggagcataaaggcacagttcagagacagaataacagggatcacaagcatgaattaaaaggaatttatttgcttcaagttcctagatacaaccttcccatgctgcacttctccactgtcggagcacgttccgaaaaacagaatgccttgatccctggtgggtgcgaaggcagttgttagggatggcaggcattggtgggctccaaaagatgaaggccccacacacaggtgtgctgcatttgggatctgtgtgggtgtttcttggaccctttcttctgggagtagggtacacactaacgtttaatccgctgtctgggtgcatgtccacagtacggtggctaaactcgaacatcactgcaaataggacgctgagcaggtccgtctgtcatgtcacgccactgcacaggtccttgtccccacacgacggggagtacttgcgtcagatgttattgaatagctcgtctcgggcaggggaagcggggagttggggatattaattgggggttttaattctattatcatgtcagctgacattatgactatataatgtagttagagacaatttttatcttgcttatagtaaaggttcagcctgccaattgtaaatcattctaatttggcaggcttatttttgacattggaaagggcagaaagcgatttgccccagtagtgtaataggagttatagaccagaggctgaaacccaaactatataaaaaggaattcagtggagggggctttgtaatctccattaatttgtgttgctacttccaggatcaccaaaaattacatgtaattttacatgttaaacacattgaaacataacctatgtttataaagcataacgggcttcccttccagaagctctcctgcttgtcatgaagtgagaacaatgaaaagtcatagcagatactcagtttaactctgtgtagaacctagtagtgtttgagctgttattcagatttgaattcagactgtgtgttgtttgcttatggacactgcctgtcgttctgtcactgttaaattaatgagtctataaggtttttcttccagaggccataggtgacatcactaaaattgcaagataaattgtaatctttgctgctgctgcactccccaacctctcccccaccccccgtggtgtgctgctttctagatgagcgtgttttggagcaggcccatctgggacactctatgctttcaccaaggaagtgcgatctgagcagccacaatccagccaaaagaggatcgtagatatttgctctgatcaactagatgaaaatatagcagaatggatttagcccactgctctgttttatccaactgagtctctgaccagcaattggtgcataattattacagcaaaactgttactagtggacttcctgtgaggaagttagttttttgttttgatgaaatgctttcgttttttaaatcttaattctgctgtccacatcctcccaaagtgtgcttacttcatttgtttaatttaaatgaactttcctccttgtatgtatgaggtgacttggtgggtggggtgggtggtttttgtttttgtgttttttctttcttagggcatctgtaggcctcaaaggacctttcctttaggtcatattcctcagaaagtcttcaatcttcccttgtttttgtttgtttgtttttcttaaagaatattttcaaagcttaaatttgtatattaatttaggactatttagaagtataggctgtcgttggcggcagcagtatattctgaaatgtctcatagatatatatttttgaataaagatggtgttgttgaacaaaaaaaaat

SEQ ID NO: 311339 - DNA, 4079 bp, Homo sapiens
ttaatattaaaaaaaaaaaaaaagccctaaccctgttacattgtgtccttttgaaggtactattggtctgggaaacagaagtccgcagggcctccctaatgtctttggagcttaaaccccttgtatatttgccccttttcaataaacgccccacgctgatagcacagaggagcccggcatgcactgtatgggaaagcagtccaccttgttacagttttaaatttcttgctatcttagcattcagataccaatggcttgctaaaagaaaaaaagaaatgtaatgtctttttattctcaggtcaatcgctcacactttgttttcagaatcattgttttatatattattgttttttcagtttttttttttttttttgttccagaaaagattttttgttttgttaacttaaaaatgggcagaaagtattcaagaaaaacaatgtgaactgctttagctttctggggatttttaaggatagcttttctgctgaagccaatttcaaggggaaaagttaagcactcccactttcaaaaaaaaaaaaaaataataacccacacacacaaagagtgttgaggacttgtagcttaaaaaaaataagttttaaaaactgactttctgtatttatgatagatatgaccatttttggtgttgagtagattgttgcattggaaatgaactgaagcagtatggtagattttaaaaggaaaaaaaaaaaaaaaccttttgtgtacatttagctttttgtatggtccagctgacagctcctcatttgatgttgtcttgttcattcctagcagatgatagattgcaatccgttgattcgcctaagcttttctccccttgtcccttaattccactttctctttcttgtcccttaattccactttctctttccttctcccacctcccgtcctataatctcccacttaaggtagctgccttcatttcttagagggagctgcagaattattttataaaactaaagaaagaatttcaagggattctaggggtcattaggatcctcacagattatttttggttggggagttgaaactttttaaaggcatataattctagttacctgtgtctgttagctttgtgcatttattttttatttatccttcttttggcttttttttctttgtaccccttcttttcctccttgtttggtaggagcttcaaatattctttttttttctatactaaaggatttgtttccatttgtgtaattggctgtgtacttttcttttctaaaaaaagtttttggttagggatttggtttttggttttgtgtttgttttttctttcctctctcagaaaaaaaaatttcatgctttaaataaaatccaaagacacaccctttcactgctgatgcagaaaaaagggaaagggttcttgttacttgagaatttgtttctgatttaaacaaacaagacttagtttaataaaagaaagagaaaaacaaaagattcccaggttgttatgtgcttcttctgcaagcagagaggcaaatgttaatgacaattccatataccaaaagacacattttttacttcaaagttttgtccttgtgttaggcagtctgagcagcgagtgatccagagcgcagccaacaaagcagcagatagcagtgtacagaaagcaaaaaaggaactgtatgtgaggcacttgtttctgttaatatccatattcctgttaacacacaccctttctcatgtaaaaagaaaaataaataaatggtctgaactttgaaaactttgtgctgctaaaacatagattttggagacaaataaatagatgctttgctgtttcactttcatagctaaacatcaacagaaaccatctccccttgcccccaaagtgtgaaatccttcttcccttcgttttcttccttatgtttcaaaagggaactttgaagactgtgaatacaggttccattggtcacctttcgggcttctttccccagtgctgaagccactcatcgactttgcaaaagactggagcattccaagatctgaaaatggattttttttctttttttcttttttagccgggactattttatttttatgaatttgtttttagtttaatgaaatagtagatcctgaaatgttgtacatatttctaactaggctgatgcacagtgcaaattccttttttaattgttttttttaagtagaaatactaaagaaagaataccatctaactattcataccagtatccagttgtagcataaggtgtcaaaagcaagtacgcaaaacatttactgttttaacaagctatttccttttaacaagaaatcttgtatttcttcctgtgtttgagatgaacatttttaaattttaaagttgtacagttttttgttttccattattttatcttgtttgtaactctatgaaatatatatatatatattttttgccatttaactgttgtatgttactctgtgtctgtaccatatagaaaaaaaattgtttttgtttttggttctctatgtgatatcagttaacaatgtaacactagctttacctgtcaaattctgctaggtcttctctgaaaacgttgtttttaaaaatgatattgcttggtaatagtgcaatttctatccttttccctcccccctcaacttttaagttcttttctttataattttgctgccccctccctgatggtttgggttttgtttttgtttttgttttttttttcatggagctactatgccatcctccctctgtgaggcagagtgactgtcagtgttttgttatgccatgccttgagctgtgggtgtttggcgacaataaggtggttgaatagatgggctgagcacacttccacccacctagtgttctcagaggggttatgtgattgtttcaacctggagtgggttgcacccttaatgctttcctctgcaactaaaccgcccacatatatgttcattgaaaaaagtaagaataattctcagcactaacccagaagtagcaaagcagtcagtgatggtgaacattagaggtcaaacatgagttagatgtttgtgggctgacagccatcgtggctatgaccagtactatttacaaagcatgaattcactacaatgctcaactgtttgtttagctttatctcacttggggaatttattcctgtctgctgcattgtaggtagctgggtaggatatatttccacttgctttttaaattagttcttcacctccattgacactcgttttttggttttctccctatagtgtgggttggtgctagacaccagtctgacccacagaatgggagttatttcatccatctttcctccatccttccaaaaaccacatatctacacaaggaaaaatttaatacatctaggaattttttttttaattacaagctatttaaagagatgaatgtggccaaagttttacacaattgaaaataaagtaaaacagacggcatgtgtttaaacctgagtttatcaggcatggcaggaagttgcaggagagagaggcagtgacccaagccagtgcacttgatgttcatggacatatattttttttaaataataaattaaaacattttaaatagaagcataaattgagttgtttgttggcgctgagatactgcccactgtgaaacaaagctttgactagttttttgtttgtttactttcttcaggggggaggggggcaagtttgggtaggaaagaaagcataaatgaacgtgaccctgaggtgaagaggtatatgaacagcctttgcaatgtacaaaaagaaaaaaaaacaaaaaacaacaaaaaaaatagagcaagtgaaaccaaaaatgatgttcttggtgtttttctataatgtagtcttgttagcttttttgttactgtaacaatgctgatctcgaactgtaccaaaatacatggagactaacaaacagaaccacatggaactttcaaactgaaaaaaaaatttgtcacaaaaactttgttgtcatagttaagttgattgtagatggtaattgaatatactcctttgaaaatatttcatcaagtatgtttcctgctcattgtgatacattaaaaaaaaaatatgagcaaaaaaaaatg

SEQ ID NO: 311340 - DNA, 430 bp, Homo sapiens
ataagtatgggttggagacccttccaagggttcgcccgttcttttcccctttcctccctcccccggaggaaatagaggagaaggggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 311341 - DNA, 2331 bp, Homo sapiens
cgccacgtgacccgcccagggcagggtcggggctgggctgggggccgcgagcccaggcgtctgagacctactgactggccgcgggcagggctgacaggcggtggggcggctcggcccctggcggagtcggcggcgggcggggacgcggcgctgggaggacgcggcggcgctgggaacggacgcctgggcgccccgaggcgccgggatgtggagcggcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaagatcgacatgctgcaggcagaggtgacagccttgaagacgctggtcatcacgtccacaccagcctctcccaaccgcgagcttcacccccagctgctgagccccaccaaggccgggccccgaaagggccactctcgccacaagagcaccagcagcaccctctgccccgccgtgtgtcccgctgcgggacacaccctcaccccagacagagagggcaaggaggtggacacaatcctgtttgcagagttccaggcctggagggaatcccccaccctggacaagacctgccccttcctggaaagggtgtaccgagaggacgtgggcccctgcctggacttcacaatgcaggagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggatcaccgcagtgtgcaacttcttcacctacatccgctacatccagcaaggcctggtgcggcaggacgcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcataaaggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 311342 - DNA, 2657 bp, Homo sapiens
ctaggccctgcctcagctgggcaggaagaaggagacccagcttggctgggggcagtaggcagggggccccggggtaagtcagccaggcctggatgctgcctccaggctttatgtgggacacctgccagcccacacccctctcttgggccagtcacagaacaaatagggcagaggccaagaaagaaaaggagggggcttggcatagctggacaggggtgctgggggacactgccagtccagggcccggaagccagacagacaacagcacctccaccctgagctcaggcagccctgatccctgaaggacggagtaaactcaacattcaaagagatagaaacataagccctgggcaccacagaaagacgacagaaaccaggagaggctgggatacacctaggtccaacttcatcaaacccagtcctgcccatgacaacggaatagcatggaatagaccagagctggaccaactagagacacaaggcaagaggatccactgtgctgcgaggtcccccatggactctgccaggctgcagtcggccagcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaagatcgacatgctgcaggcagaggtgacagccttgaagacgctggtcatcacgtccacaccagcctctcccaaccgcgagcttcacccccagctgctgagccccaccaaggccgggccccgaaagggccactctcgccacaagagcaccagcagcaccctctgccccgccgtgtgtcccgctgcgggacacaccctcaccccagacagagagggcaaggaggtggacacaatcctgtttgcagagttccaggcctggagggaatcccccaccctggacaagacctgccccttcctggaaagggtgtaccgagaggacgtgggcccctgcctggacttcacaatgcaggagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggatcaccgcagtgtgcaacttcttcacctacatccgctacatccagcaaggcctggtgcggcaggacgcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcataaaggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 311343 - DNA, 2361 bp, Homo sapiens
cgccacgtgacccgcccagggcagggtcggggctgggctgggggccgcgagcccaggcgtctgagacctactgactggccgcgggcagggctgacaggcggtggggcggctcggcccctggcggagtcggcggcgggcggggacgcggcgctgggaggacgcggcggcgctgggaacggacgcctgggcgccccgaggcgccgggatgtggagcggcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaagatcgacatgctgcaggcagaggtgacagccttgaagacgctggtcatcacgtccacaccagcctctcccaaccgcgagcttcacccccagctgctgagccccaccaaggccgggccccgaaagggccactctcgccacaagagcaccagcagcaccctctgccccgccgtgtgtcccgctgcgggacacaccctcaccccagacagagagggcaaggaggtggacacaatcctgtttgcagagttccaggcctggagggaatcccccaccctggacaagacctgccccttcctggaaagggtgtaccgagaggacgtgggcccctgcctggacttcacaatgcaggagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggatcaccgcagtgtgcaacttcttcacctacatccgctacatccagcaaggcctggtgcggcaggacgcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccagtccccagaactgcctgcaggtgccttgttgctggcttgtcttcagaaagggactgttctgggtggctggatctccaggtaccctccacccagctgccaagccctgggcagcagcacccccttgtggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 311344 - DNA, 2126 bp, Homo sapiens
cctggtggggggaagaaggctcctgctacctcccttcccggcaccctccagagggaccctcagtctggtcttgcaagcatggactcttctgaggagcacgctgggtgccccgcccgagggacatgtcccgtgttcctggccatgagtgcagggactgtccgctacgccccatcaggcctgtgccctgtacttgaggggaacttgagagaagagccctggggcacagacagcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaaggtggacacaatcctgtttgcagagttccaggcctggagggaatcccccaccctggacaagacctgccccttcctggaaagggtgtaccgagaggacgtgggcccctgcctggacttcacaatgcaggagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggatcaccgcagtgtgcaacttcttcacctacatccgctacatccagcaaggcctggtgcggcaggacgcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcataaaggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 311345 - DNA, 1384 bp, Homo sapiens
gcccagccccttaccaccctgcctgcctccctggtctgccacagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggatcaccgcagtgtgcaacttcttcacctacatccgctacatccagcaaggcctggtgcggcaggacgcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcataaaggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 311346 - DNA, 2345 bp, Homo sapiens
cctggtggggggaagaaggctcctgctacctcccttcccggcaccctccagagggaccctcagtctggtcttgcaagcatggactcttctgaggagcacgctgggtgccccgcccgagggacatgtcccgtgttcctggccatgagtgcagggactgtccgctacgccccatcaggcctgtgccctgtacttgaggggaacttgagagaagagccctggggcacagacagcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaagatcgacatgctgcaggcagaggtgacagccttgaagacgctggtcatcacgtccacaccagcctctcccaaccgcgagcttcacccccagctgctgagccccaccaaggccgggccccgaaagggccactctcgccacaagagcaccagcagcaccctctgccccgccgtgtgtcccgctgcgggacacaccctcaccccagacagagagggcaaggaggtggacacaatcctgtttgcagagttccaggcctggagggaatcccccaccctggacaagacctgccccttcctggaaagggtgtaccgagaggacgtgggcccctgcctggacttcacaatgcaggagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggatcaccgcagtgtgcaacttcttcacctacatccgctacatccagcaaggcctggtgcggcaggacgcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcataaaggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 311347 - DNA, 1847 bp, Homo sapiens
cgccacgtgacccgcccagggcagggtcggggctgggctgggggccgcgagcccaggcgtctgagacctactgactggccgcgggcagggctgacaggcggtggggcggctcggcccctggcggagtcggcggcgggcggggacgcggcgctgggaggacgcggcggcgctgggaacggacgcctgggcgccccgaggcgccgggatgtggagcggcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaagatcgacatgctgcaggcagaggtgacagccttgaagacgctggtcatcacgtccacaccagcctctcccaaccgcgagcttcacccccagctgctgagccccaccaaggccgggccccgaaagggccactctcgccacaagagcaccagcagcaccctctgccccgccgtgtgtcccgctgcgggacacaccctcaccccagacagagagggcaaggaggtggacacaatcctgtttgcagagttccaggcctggagggaatcccccaccctggacaagacctgccccttcctggaaagggtgtaccgagaggacgtgggcccctgcctggacttcacaatgcaggagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggatcaccgcagtgtgcaacttcttcacctacatccgctacatccagcaaggcctggtgcggcaggacggaggcttagggcgcggcccaggcctgaaggggagctctgagacagagcaaacacccacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcataaaggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 311348 - DNA, 1488 bp, Homo sapiens
gcccggttcatctcacagctctgctgcatgctggttcattagctccgccatctccgtgatggatgtcagcggctttccccgggtggctccgctttcccccatgtaagatggaataataagcgcgtctgctccgttcgctgcaggcgcttgatgaaatggctgctgctgctgctgctgctattacagcagggctagtcatgctgttgttgattactacttgaaagcccagtcccagctgagtcagggagcactgcctggctctgcagggacctggggcctcctgctctggactcagatccgcctgtcaggggacccccagcgtggggctggcaggtcacaccgtccccacctctgcccacagatcaccgcagtgtgcaacttcttcacctacatccgctacatccagcaaggcctggtgcggcaggacgcagagcccatgttctgggagatcatgaggttgcggaaggagatgtcactggccaagctcggcttcttcccccaggaggcttagggcgcggcccaggcctgaaggggagctctgagacagagcaaacacccaccccagaacaagccgacacacagggagacgggggcctggagccagccctgagccagaggcagaatggatggacagacaggccatggaggcagcactgagccagcaccacacgtccatcctgggacagacgggcctggacttcacggcaagacccccctctcttccccactgggttctgccaccaccaggaggatttcaagaaagcaccaaagaccagggagctcggatccatactcggggggcctcagcccttgggaggggacacctgaggcagccagcgccccctccccagtccccagaactgcctgcaggtgccttgttgctggcttgtcttcagaaagggactgttctgggtggctggatctccagggtaccctccaccccagctgccaagccctgggccagcagcacccccttgtggccatcctgtgccttgttcccggtggcctccctattggactactaggaggggctggcagggcctccatagcacagaattgccccaaagccttgttaagatgagtcaagacccctcccccgcttcctcccttcctttcccccttcctccctcccccttcataaaggcctcccttgtcaccttccctcccaccccgtctcagccctgtgctcctggaggccctgctcccaaaaccgctggaaggactggggcactttctgccacagtagaacacagacagggcttcagatcacccacgcctgttttcagctgtgggtggccatgcagacacgcgccctggcatgtggggcctgggtgggcaggcaggacctgggccctcccacccatcagagcccactcaggaccagcgttcggagctcccacctggacgcatccctcaccacgtccggatttccttctttggatggaatgtaacgcgatctctatttaataaaggcaggctttgttggta

SEQ ID NO: 311349 - DNA, 1561 bp, Homo sapiens
cgccacgtgacccgcccagggcagggtcggggctgggctgggggccgcgagcccaggcgtctgagacctactgactggccgcgggcagggctgacaggcggtggggcggctcggcccctggcggagtcggcggcgggcggggacgcggcgctgggaggacgcggcggcgctgggaacggacgcctgggcgccccgaggcgccgggatgtggagcggcccaccccagccagaccagggcctcccgccgccccttgcagctgtcccggtcccctggaagagcacggacccctgccaaggccacagggagtccccaggagccctggtggagacctctgcaggggaggaggcccaaggccaggagggccccgcagccgcccagctggacgtgttgcgcctgcgcagctcttccatggagatccgagagaagggctccgagttcctgaaggaggagctgcacagagcgcagaaggagctgaagctaaaggacgaggaatgtgagcggctgtccaaggtgcgggagcagctagaacaggagctggaagagctgacggccagcctgtttgaggaagctcacaagatggttcgagaagccaacatgaagcaggcggcatcagaaaagcagctgaaggaggctcggggcaagatcgacatgctgcaggcagaggtgacagccttgaagacgctggtcatcacgtccacaccagcctctcccaaccgcgagcttcacccccagctgctgagccccaccaaggccgggccccgaaagggccactctcgccacaagagcaccagcagcaccctctgccccgccgtgtgtcccgctgcgggacacaccctcaccccagacagagagggcaaggaggtggacacaatcctgtttgcagagttccaggcctggagggaatcccccaccctggacaagacctgccccttcctggaaagggtgtaccgagaggacgtgggcccctgcctggacttcacaatgcaggagctctcggtgctggtacgggccgccgtggaggacaacacgctcaccattgagccggtggcttcgcagacgctgcccacagtgaaggtggccgaggttgactgtagcagcaccaacacatgtgccctgagcgggctgacccgcacctgccgccaccgaatccggctcggggactccaaaagccattactacatctcgccatcttcccgggccaggtcacgcagtgttgcaaacttttcacctacattcgttaattcagcaaggctggtgccggaggacgccaagccatgtccgcgacaacttaacgtgcggcaggagatgtctggcacaaccgggttatccccaggagtaggcgcggccggacctgaagggaacctgtaaacggcgcaaaccgcccccaaaaagcgactcctgacgacgcgcccgatccaccgtacctaagcgagtgtgtgcccaccattgactccttccgacgcacattgcgaagcgcggatacgtaaacctctccggtgtcccaacatatccacacgcgctatatgctcttggtatacgaccccatatgttgagtaggac

SEQ ID NO: 311350 - DNA, 6046 bp, Homo sapiens
agcggcctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaatgtaatgactttcttaaaacttaagtgttaggttgattttacatggctgagttcaggccttctgtcttgacagaatagtgactgatatgtcattatatttatgtatattttgtttcctaatgtcttgcagccttttggaccgcagatattaaatgtataggctaaagagct

SEQ ID NO: 311351 - DNA, 5548 bp, Homo sapiens
agcggcctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcattagatttgcctttcattgcgggcttaggcagatctacgcctgaaga

SEQ ID NO: 311352 - DNA, 6495 bp, Homo sapiens
agcggcctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcaaaaacaaacaaacaaacaaaacaaaaaacaaaaaaaaaaacaaaaaaaaaaaaaaaaaaaaaacaaacaaaaaaagagagggggggcggcgcgcaaggagaatatatcccgagcatcaggagaagggagcacacaaaggtggaggcagcgaagcaccgcgatgatggagggaaaaagagagggtggcacccaatcagaaaggagagcgcgagtattaataaggaaaagagagagagggaggacgaagaggagaataacaaaggagagagagaaggaggggagaacaagagggaaacagagggaggaaccaactatgggagaaaaaagaccacacttatagcagggaggggggcagggagaacaaacaaaagggagagaacaaaaaacacaatacacaagagcagcaattacaaccctcctacagcggaggagaaaaaaaaaacaaagaataatagaggcgaggagtatatacacggagtggagaaaaaacaaaaagaggaaagaatggaggcacggcaggggagaaagacgaaaagctcggcgaaaacagggagaacaaaaaaataagcgagaaaaaaaaaataagaacacagcgggggacacgctcagacgagaaaaaaagaaaaagagaagaaagaagcagaagaaaaagaacaagaaaggagactaagacgagacagagagaaaagaagaagagagaagaaagcagacgagagaaatagacagagctagccatgacatactacgggaagatgaatagaagaagtgaacgatacgacataaacaaagcaacaacaagaagacacggggaaaggagccgtcagggactaagggccgacgagcggcgagagcagaagaccagaca

SEQ ID NO: 311353 - DNA, 5803 bp, Homo sapiens
agcggcctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtgagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311354 - DNA, 5672 bp, Homo sapiens
agcggcctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggtttatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcggtattattattgggtataaaaaaaaaaaagaaaaaaattgggggggggcggaatttaaattgggggggcaggaaagaaggaagtcaaaagggaggggtgtccaaaggggggggataaggtggtgtagagctctctggcagggggagaagaaagaagggagagag

SEQ ID NO: 311355 - DNA, 5454 bp, Homo sapiens
agcggcctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgaaaaaaaaaaaaaattaaaattaggggaaacccttttaattggaaatcccgggggtggaaaaaaaaaaaaaaccccgcttgggaaaaaacccccggggggaattcccccccaaaaaggttaaaagaaaaaaaaggggggtcctcttcccgctgcaaaaaaaacgggggggggtttttgggaaccccctttc

SEQ ID NO: 311356 - DNA, 4933 bp, Homo sapiens
tccttctggccacgcctacaaactacagataaaatttgatgtctctctaatcaaactcttaagagtagtactcaagaaatggtggtatgcttggcaaataagatcatgaagcttttcatgttcttttttcttttttactggttattgatgacatatgaacattttagaaaatgtaaagaaaattataaacttgtaattttgtttcattcttttgaaatcttatgtataggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311357 - DNA, 4170 bp, Homo sapiens
  misc_feature (20)..(20): n is a, c, g, or t
  misc_feature (26)..(26): n is a, c, g, or t
ttttttttgtgtgtgaatangaaatngcttaaattattccaaaccagcttgatgaccaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311358 - DNA, 3304 bp, Homo sapiens
gagtgaaatgataaatttaagggagaatatttccctaagtattcatcacagggcgaagtataaagcgttgagctcaacgctttatacttcatctcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtgagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311359 - DNA, 3076 bp, Homo sapiens
aatcgctggtggtcactagaacttcagactctcgactcctgagtcggacgtcttagtatcattggaccgcggctgttaactaggtcgtcggagtagagagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311360 - DNA, 2352 bp, Homo sapiens
ccgcgatctagaactaggaaacagctgtacaggccaggtataatttatacatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311361 - DNA, 2040 bp, Homo sapiens
agcggcctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagccaagtcaacacaacttctctaggatattctgtccattgcaccattttacccccaattcttaggtgtactaaagttttgttccagcttggattgtgcacagtaactccaatactatcttcaccactattcccatgcctcacccccactaaacctgctgggctgggcctgtactgaatctccgcaccaccctctacccactccaccctacctaaccatcttggctggatcagcggatcgagtaagtacctggaacagc

SEQ ID NO: 311362 - DNA, 3378 bp, Homo sapiens
agcggcctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaactcgagtttttttttttttttttttttttactcaaatggtttttattttcctatctgacatttctaacaaaacgccaggtagacggagttaaaaagaatccaccgcacgaaaggtaaacaaagcagaccctcagaaactccctggcaaggatgttcccctccccagattggcccagtttcaccagcaactggtctcagctcagccttatgcctttccactgacaccccccacccctccacattctcgtgattcagaccaggaacttctcggctgattgtgtccgtgtgtctgagggaggggcacgctggaacctgggaacctactgggcacctctaatgcagatgagaaaaacttgagaatgtgaaagtagatcagtccccgctcccacccgaaggtgcagagacgcgggacattaaccagcagcacgcgggggtgaagtaactcaggccactctcctccccactgcccagggcgggtgcacgccccaggacctcctcccaggccccacacccacgcaaggcgacaggaagctccccacgcctgccccatgacgcaacgatgaccgcttatacaagtatgtcagcggagggggaaggggagtgcctggaattctccgaggttggaaacgcaaaaccaactcttgaaaaaccttgaaagggccagcacagcccacagtacaaaatgaagtccgaccctgaggagatctttaaaaacaaacaaacaaacaaaacaaaaaacacaacacccaagcctcccttctcccagtccagaaggagagcgaaaggttcacgtcccagtccactaagacagcacctgtgggcgcaggtctctgcggaaggcgcccgcgcccccggctcagactcctcggtgccgtccctgcacactgaaggcgatggctccccggggacagagtccctctccgggcctctcagcagcccgggcggcggcttctctccacggttttcgcgggcgcttcccccaggatggaggggggtggcctcgcctcaggtctgcgccctcgggccgacggttcgacgcgcgctctgggctccggcagcgccgctcggggtcctcagaaggccaccacggcccgcacgagcacgttgagcatgctgtccgccgggcggcaagcgggctttgcctcgcacgcgggcggcgccgtcggaggggccgcggggctgcagttcaggaggccggagaagcgcctctgcaggacgcgggccaggttgggaaaggcgccctccgcttgcgccggagggggctgcaggcgatcggcgacttcggatgacgctccctcctcttcttccttttcttccagacgggctttcttgctcgggaccagtccagcgtccccgccgtcgctcaggctgctgctgcgtcgtttgcggctgactttggcggggcgcggggcacagcaggcggaggtctcctcggctgtcggcgcctcctgcgtgtccattggctccggaaacgggtgctcaccgtcgggggtcgctgtctcggccgtggactcggcttctcggggcgggtgcaggcgagggtcagaggggagggcggccggcaacgacacctcgggctcgagggcctccaccttggccgagaggtagagctcccgggcgctgcgcatgaccagcgacagctgcagactccggtgcagccgcaggccaccgcgctgcatgcgggagtgatacatcttccacaccgacagggtcatgatgcgctgtgcctctttctgcacttccatggcgactcgacggcgacagcggcgggggctcccgggagggacagaacaggcagcaggtgcactccggacaacgggctcgctcacgcctctctacacaaaccaacccacgcagtgacactgc

SEQ ID NO: 311363 - DNA, 174 bp, Homo sapiens
ccgccggtgccccccccatcgtgccccgtcatacctctcagtatggcattatagaacggggaacacccccaccctcccgaaatacttggtttgggaagacaccgtttaattttaagttaacttgcatgttgtaaatgcgttttatgtttaaataaagaggaaaattttttgaaa

SEQ ID NO: 311364 - DNA, 5817 bp, Homo sapiens
agcggcctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggccagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311365 - DNA, 5821 bp, Homo sapiens
agcggcctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggacttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311366 - DNA, 5192 bp, Homo sapiens
cgagcggccgcccgggcaggtacgcgggtggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311367 - DNA, 4910 bp, Homo sapiens
agctgtaatttggtattaaagaaaataagcatttgaatcaaataatgaggtcaaagcctggcaaacataatcctctgttaagcctgtagacatgcatgacaggttaatataatctgtatgagatgattaggaaaatcagtaatgatgattccgtctttgactttcaacagtaatttcttaattcagccttgcaaacaaattggaaaaatataggcctttgtcttttatttttagtggtttgttgatttttttttttttaaagctattcacagattttggagcagactcaaatttagttgagttgtaaataacgtcatatgttgcggcttttagtatttagtctaagagattactggacaagcataagtttcttagccatatatacatatattccatatagataaaattaaaaataatttcagtctcatcctttttttcctccaattacatctcttagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311368 - DNA, 4081 bp, Homo sapiens
tagaggatccctgctctgactatagttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311369 - DNA, 3169 bp, Homo sapiens
  misc_feature (6)..(6): n is a, c, g, or t
  misc_feature (8)..(8): n is a, c, g, or t
  misc_feature (10)..(10): n is a, c, g, or t
  misc_feature (32)..(32): n is a, c, g, or t
ctcgtncncntcgtgccgaattcggcagaggnaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311370 - DNA, 5875 bp, Homo sapiens
agcggcctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaa

SEQ ID NO: 311371 - DNA, 5995 bp, Homo sapiens
agcggcctgtcgcccaacggcggcctcaggagtgatcgggcagcagtcggccggccagcggacggcagagcgggcggacgggtaggcccggcctgctcttcgcgaggaggaagaaggtggccactctcccggtccccagaacctccccagcccccgcagtccgcccagaccgtaaagggggacgctgaggagccgcggacgctctccccggtgccgccgccgctgccgccgccatggctgccatgatggatcggaagtgagcattagggttaacggctgccggcgccggctcttcaagtcccggctccccggccgcctccacccggggaagcgcagcgcggcgcagctgactgctgcctctcacggccctcgcgaccacaagccctcaggtccggcgcgttccctgcaagactgagcggcggggagtggctcccggccgccggccccggctgcgagaaagatggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattgctaaacctattcgtcccgggcaacatccagcagcttctccaactcacccaagtgcaattcgtggaggaggtgcatttgttcagaacagccagccagtggcagtgcgaggtggaggaggcaaacaagtgtaatcgtttatacatacccacaggtgttaaaaagtaatcgaagtacgaagaggaacatggtatcaagcagtcattcaatgactataacctctactcccttgggattgtagaattataacttttaaaaaaaatgtataaattatacctggcctgtacagctgtttcctacctactcttcttgtaaactctgctgcttcccaacacaactagagtgcaattttggcatcttaggagggaaaaaggacagtttacaactgtggccctatttattacacagtttgtctatcgtgtcttaaatttagtctttactgtgccaagctaactgtaccttataggactgtactttttgtattttttgtgtatgtttattttttaatctcagtttaaattacctagctgctactgcttcttgtttttcttttcctattaaaacgtcttcctttttttttcttaagagaaaatggaacatttaggttaaatgtctttaaattttaccacttaacaacactacatgcccataaaatatatccagtcagtactgtattttaaaatcccttgaaatgatgatatcagggttaaaattacttgtattgtttctgaagtttgctcctgaaaactactgtttgagcactgaaacgttacaaatgcctaataggcatttgagactgagcaaggctacttgttatctcatgaaatgcctgttgccgagttattttgaatagaaatattttaaagtatcaaaagcagatcttagtttaagggagtttggaaaaggaattatatttctctttttcctgattctgtactcaacaagtcttgatggaattaaaatactctgctttattctggtgagcctgctagctaatataagtattggacaggtaataatttgtcatctttaatattagtaaaatgaattaagatattataggattaaacataattttatacggttagtactttattggccgacctaaatttatagcgtgtggaaattgagaaaaatgaagaaacaggacagatatatgatgaattaaaaatatatataggtcaattttggtctgaaatccctgaggtgtttttaacctgctacactaatttgtacactaatttatttctttagtctagaaatagtaaattgtttgcaagtcactaataatcattagataaattattttcttggccatagccgataattttgtaatcagtactaagtgtatacgtatttttgccactttttcctcagatgattaaagtaagtcaacagcttattttaggaaactgtaaaagtaatagggaaagagatttcactatttgcttcatcagtggtaggggggcggtgactgcaactgtgttagcagaaattcacagagaatggggatttaaggttagcagagaaacttggaaagttctgtgttaggatcttgctggcagaattaactttttgcaaaagttttatacacagatatttgtattaaatttggagccatagtcagaagactcagatcataattggcttatttttctatttccgtaactattgtaatttccacttttgtaataattttgatttaaaatataaatttatttatttatttttttaatagtcaaaaatctttgctgttgtagtctgcaacctctaaaatgattgtgttgcttttaggattgatcagaagaaacactccaaaaattgagatgaaatgttggtgcagccagttataagtaatatagttaacaagcaaaaaaagtgctgccaccttttatgatgattttctaaatggagaaacatttggctgcatccacatagacctttatgttttgttttcagttgaaaacttgcctcctttggcaacattcgtaaatgaagcagaatttttttttctcttttttccaaatatgttagttttgttcttgtaagatgtatcatgggtattggtgctgtgtaatgaacaacgaattttaattagcatgtggttcagaatatacaatgttaggtttttaaaaagtatcttgatggttcttttctatttataatttcagactttcataaagtgtaccaagaatttcataaatttgttttcagtgaactgctttttgctatggtaggtcattaaacacagcacttactcttaaaaatgaaaatttctgatcatctaggatattgacacatttcaatttgcagtgtctttttgactggatatattaacgttcctctgaatggcattgatagatggttcagaagagaaactcaatgaaataaagagaatatttattcatggcgattaattaaattatttgcctaacttaagaaaactactgtgcgtaactctcagtttgtgcttaactccatttgacatgaggtgacagaagagagtctgagtctacctgtggaatatgttggtttattttcagtgcttgaagatacattcacaaatacttggtttgggaagacaccgtttaattttaagttaacttgcatgttgtaaatgcgttttatgtttaaataaagaggaaaattttttgaaaaaaaagggggggttaaaatccgagggcatttggtccgttttggaagggcctaagggtataaaaggggggttaaactgtgaaaggtggtttggaccttgtggttgacctgcggaatgtggg

SEQ ID NO: 311372 - DNA, 5519 bp, Homo sapiens
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcacatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaattttttttttttttttttgtatttttagtagaggcagtgtttcaccgtgttagccaggatggtctcgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattca

SEQ ID NO: 311373 - DNA, 5379 bp, Homo sapiens
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcacatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaattttttttttttttttttgtatttttagtagaggcagtgtttcaccgtgttagccaggatggtctcgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattga

SEQ ID NO: 311374 - DNA, 5325 bp, Homo sapiens
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcacatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaattttttttttttttttttgtatttttagtagaggcagtgtttcaccgtgttagccaggatggtctcgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattga

SEQ ID NO: 311375 - DNA, 5232 bp, Homo sapiens
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcacatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccacacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattga

SEQ ID NO: 311376 - DNA, 4530 bp, Homo sapiens
cttcctttcgagaaattgcaattaagacttggaccgttaggttaaataatctttacattgttgtttggcacaaatttgctataatgctttaaaacttttgaaaaacttgtattttggcatttttctattcttatgacttatttttcttttgatttcagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcacatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaattttttttttttttttttgtatttttagtagaggcagtgtttcaccgtgttagccaggatggtctcgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattca

SEQ ID NO: 311377 - DNA, 4446 bp, Homo sapiens
ggtctcgatctcctgacctcatgatccacccgcctcggcctccgaaagtgctgggatttcaggtgtgagccaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcacatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaattttttttttttttttttgtatttttagtagaggcagtgtttcaccgtgttagccaggatggtctcgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattca

SEQ ID NO: 311378 - DNA, 4578 bp, Homo sapiens
aagtgaactctcagtcaaaattgcaaaggaaatgacttgatttcatgaagtatttccagaagtaacattattgtatattcctacatcctgaatatatatttccagtaaagagttgaaaatctgggcgctcgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcacatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaattttttttttttttttttgtatttttagtagaggcagtgtttcaccgtgttagccaggatggtctcgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattca

SEQ ID NO: 311379 - DNA, 4324 bp, Homo sapiens
ctcaagtggtctgctcgccttggcctcccaaagcgctgggattacagacatgagctactgcacctggctattttatttatttaaaagaatttgattttttagagataggatctggctatgttgcccaggctggagtgcagtggcatgatcatagctcactgtaaccttgaacttctgggctcaagcagttctcctacctcgggtttccaagtagctacgactacatggcacacacagccatgcctggcaatttttaatttttttttgtagagaccaggtctccctgtgttgtccaggctgttctccaattcctggcctcaagtagttctcccgtcttggcctcaaaaaatactgggattacaggagtgaatcactgcacctggcatatgtatttaaatacttttaaaataactaatttctagacattaatatcttagttttaccttgtcgaattaagaactaaaatatattaaaatacattaaatggtttatgcaccttaaatttattgaaataaattactttaaaaatgttttaaaatgcaaagtgaataacttttacagataaaatttatctgagatggtttctgagtgaaatattttttggttacagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcacatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaattttttttttttttttttgtatttttagtagaggcagtgtttcaccgtgttagccaggatggtctcgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattca

SEQ ID NO: 311380 - DNA, 2168 bp, Homo sapiens
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattattggcctcgttggcctcagcggtggagctggtcacgcagaac

SEQ ID NO: 311381 - DNA, 1431 bp, Homo sapiens
atagttgggattacaggtccttccacacccccggctaattttttatttttaggagagacgggttttcaccatcttgccaggatggtctcgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattga

SEQ ID NO: 311382 - DNA, 1578 bp, Homo sapiens
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaatgtcatctacgaagaaaactgttttaagccacagacaattaaaagacctttaaatcctttggcttctggtcaagggcacaagtgaagagaacactttttacagttggctagaaggtctctgtgtagaaaaaagagcattctacagacttatatctggcctacatgcaagcattaatgtgcatctgagtgcaagatatcttttacaagagactggttagaacagaatggggaccaacattaccgattca

SEQ ID NO: 311383 - DNA, 1873 bp, Homo sapiens
  misc_feature (1872)..(1873): n is a, c, g, or t
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaaagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaattctacagtgtgaagaatttgaacttcggaactgttccggaaattcttaagaaacaagtggtgtgtccgttttggccaaggggcagaaggggtttttccagggtatgaagaggttgccaattttaaggttgtggggattgtgttgaacctaaggggtgtataaggaagaaaaaggggcaggtaaggatgaaaaggggttggcggctatgtgtaatacgctgtcgaattatataataaatatatnn

SEQ ID NO: 311384 - DNA, 288 bp, Homo sapiens
agagaacactttttacagttggctagaaggtaattagaaactttaaaataaatttcaatgatggtttttttctcatgagattaattttatgtctacaagattcacatatgaaattttatttctaagtcactgctttttcttaggtctctgtgtagaaaaaagagcattctacagacttatatctggcctacatgcaagcattaatgtgcatttgagtgcaagatatcttttacaaggtatgtgacatttacttttattcagtctaccactcttaattttagatattct

SEQ ID NO: 311385 - DNA, 3547 bp, Homo sapiens
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcacatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatg

SEQ ID NO: 311386 - DNA, 5465 bp, Homo sapiens
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcacatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaattttttttttttttttttgtatttttagtagaggcagtgtttcaccgtgttagccaggatggtctcgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccaccccccaccttttggcctcttcatttattccttaaatgttattcctcagacctccattttttttttctctcttaatcacaacaccacttctcacgcttgggtaattttaattcagcagttcctaaatccttatctttagccagactcctcaatccatctgcctgttgcacttttcttggttgtcccagagacacctgtgtgtgtcttaaaacattcattctctgcaaaacctactctaatgcctgtgtcccttactttggttaattttagaaccattatattctaagttttctaggctcattcctctcctccaccttcccctatcatttagtgtctaagttttactgattttatctccacctctctgatacatcactctttcatcttcattgctattattaataaatacctacagtactaacctgcctcctatacctagctggtctcctctctgttgctcaatgttaccacagcaggctttctagaagcactctgacagtgttactccctaatatccttcagtgacttcaggaactttcaggagaaagccaaactcctctgtttggtgtacaaggtcttctgatgtgtttcctccaccgaatgttctggtgaaacagacttacacttcttcagaagccacatttggccaggcctcccgccttggtaaatgctgtactctttgcatcaagtgtgctagtcatccttccccacttggaaaattcctatgcatcttgcaggcctgacataagcatttcctctgtgaaacctcctttgctccactcaaggagagtcatctaacttccactttcgtgtcaccactgtaattacaacctacctctattgtatgtcacttaaatcgtactgtattgttttatttttcaaaagtctttactagaatgtgagctccttaagggcaggaaaaggaacctttttattttttgcatctccatagcatagtttttggcatatgaatgtttaataaatgtttgttgaataaattgattttaaagtgacatctttattatattagaggtcctacctatattccaaatactttcactcccttcactttacagcaagggtcagtagagtcccaaggatttgtagactttagggggtcaataaagctgaaattgtattca

SEQ ID NO: 311387 - DNA, 4626 bp, Homo sapiens
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattatcaaattcatatatgataaaagtgaatgttctaagtctctcaaactagcgttttatgtaataatatgtaatataaataaaactatggtaaatgtgacaagcatttaataggaaaatgctaaggaggcctcataaatgacccataattaccaacgtagaatttttcagtacatttagggttgctggatttagcaaataaaaataaagattgcccagttagatttgaatttcagataaacaattagttttttaatattttacatggaatatttggaaaatacttatactaaaaaattatttgtttgaaattcacatttaactgggagtcttgtattttatctggcaatcctaaaatacattggtatgaaacaaatcacttttagaagtatattgctattttgattgggttgtttttgtgtgtagaaacgtacaataacaactcaaaggcacaggagatttctaaacattgtgaaaagttgaatagattatatatttattctcataatactttcactaatactaaataaaatttggggaacactttttatttttatataatttccaatttacagaaaagtttcaaaaatagtacaaagagctctcttacccagattcactaattgttcatacgtgctttatctttcatgctttctctgtacacacacacacacacacaaatttttcctcaatcatttgaaagtcagttataggcatcatgccccttaaaccctaaatacttcagtgtgtaatactgaataattactaaaaatgattttctcagaaaaaaaaactcccacaattctggaactataatactgtaagccttagaataaataatactttcaagttccaatctaaagttctttttgagttttgttgcccgttttatgcttgatgtgtatagtaatagggtaggctatttattttattaaaattttttttagagacaaggttttgctgtgttgcccaagctggaacttgaacgactgggctgaagtgatcttcccacctcagcctcccaagtagctgggaatacaggtgtctgccaccatacccagtttcatttttgttttttatacccgaagttcatttcctttgtctccctaaaactgaactgtaattttgggaggttttcattagtggaagctcttcatttataaagctatttgaaggggtttaggaatttatatcacatggtaattgtagagaaaaagaagctatatacctcaaaatcgtgccctctttacatatgtcttatcaggtataacatgttgaaatgtcacattagtagtaaagtggggtttatttatatagtggttaagaaatgtcagtttacactgctgtatacttcttcttctgtgtccctaaggcctggtacagtgccaagcacatacttggtatccaataaatatttgttggatgaatgtatgcatatgtattcagtatattttaaatgaataatcacagaagtaagtttaataatttgtcctatttttctctgtcacttcctttttctctaaggcaggaaaggaaagacattaaaccattaattaagtcaatcctcttggagactcaaaagactatgaagtgatcactctatataaaatataaatacagtgtgggttcaaatggccattttttgtgtgtccctctctctcatcttatgcttcccttcctttttttatttttattttttggagacggagtcttgctgtgtcgcccaggttggagtgcagtggcgtgatcttagctcactgcaagctctgccttccaggttcacgccattcttctgcctcagccccctgagtagctgggactacaggcgcccgccaccacgcccggctaattttttttttttttttttgtatttttagtagaggcagtgtttcaccgtgttagccaggatggtctcgatctcctgacctcgtgatccacccacctcgacctcccaaagtgctgggattacaggcgtgagccaccacgcccggcctcttttttttttagctgccaatctttttgaaggaatattcttacctctactttgtcaccttctactggctccttaactaaaatctgccatttggctctctggttaacagtcccttcctgtaaagtctaaaatcttaattctaaatccacagtttaattcacaagctagtacttgactttttttctgtatttgacatttttgacaacccctactttaaagatttattcccttgacttcttacattttgctcactcctgaaccacccccctccccaaaaatccccaaagtacggtgtggcagaaaacagcgccaacaggtcctgccagtcagaagccactcccctgatttcatggctcaagaccccaactataaattaacccttcccaccttgaatgtgtacacacactactgagatccaggccgatccttgccatgggatgaacctgagaattgccaagacccgccttcccacgttcacccaaccaaatcatgtggtatctgttacgcacgg

SEQ ID NO: 311388 - DNA, 2753 bp, Homo sapiens
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaagagacctggttagaaaagaaatggggacacaacattacagaatttcaacagcgatttgatggaattttgactgaaggagaaggtccaagaaggcttaagaacttgtattttctctacttaatagaactaagggctttatccaaagtgttaccattcttcgagcgcccagattttcaactctttactggaaataaaattcaggatgaggaaaacaaaatgttacttctggaaatacttcatgaaatcaagtcatttcctttgcattttgatgagaattcattttttgctggggataaaaaagaagcacacaaactaaaggaggactttcgactgcattttagaaatatttcaagaattatggattgtgttggttgttttaaatgtcgtctgtggggaaagcttcagactcagggtttgggcactgctctgaagatcttattttctgagaaattgatagcaaatatgccagaaagtggacctagttatgaattccatctaaccagacaagaaatagtatcattattcaacgcatttggaagaatttctacaagtgtgaaagaattagaaaacttcaggaacttgttacagaatattcattaaagaaaacaagctgatatgtgcctgtttctggacaatggaggcgaaagagtggaatttcattcaaaggcataatagcaatgacagtcttaagccaaacattttatataaagttgcttttgtaaaggagaattatattgttttaagtaaacacatttttaaaaattgtgttaagtctatgtataatactactgtgagtaaaagtaatactttaataatgtggtacaaattttaaagtttaatattgaataaaaggaggattataaaaaaaaaaaaaaaaaaaaaaaaaaaaaaaaaaaaaaaaaaaaaaaaaaaaaaaaaaaaagaaaaagaaaaaaaagaaaaaaaaaaaaaaaaaaaaaaaaaaaaagaagaaaagaaaaaaaagaagaagaaaaaagagaaaaagaaacagaacaagagaagaaagaaccgatggagaaacggacccgccgcgagggggggaatcgcggcgaaggaaagagaggagaagaggaaggagagatgcggagaggagagggagtaagtcgcgaacggggtcgggaaagggccgaagagagaaacacgagaggagaaaagacaccacgcacaacaaaacaaagagagaagagagtcaagagagagaaaaaacagaaggagaagtacagaagcggaacggaagaggacgcaagaagagaaaagagagaaggagagaggaggaaaaaaagagtaaaagaacagagcaaggcgagaacagaaaaaaaaagggcagagtcagaagaagagagagaaaaaagcagaaagaagacgaaaggaagaaaaaggagacagaagaacgagaaaaagagaacagaaaacgagaaaaagagacagaaagaagaggaagagagagaaaaacacaaggggaggag

SEQ ID NO: 311389 - DNA, 1749 bp, Homo sapiens
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaagtattctgaagaagccaataatctcattgaagaatgtgaacaagctgaacgacttggagcagtggatgaatctctgagtgaggaaacacagaaggctgttcttcagtggaccaagcatgatgattcttcagataacttctgtgaagctgatgacattcagtcccctgaagctgaatatgtagatttgcttcttaatcctgagcgctacactggttacaagggaccagatgcttggaaaatatggaatgtcatctacgaagaaaactgttttaagccacagacaattaaaagacctttaaatcctttggcttctggtcaagggacaagtgaagagaacactttttacagttggctagaaggtctctgtgtagaaaaaagagcattctacagacttatatctggcctacatgcaagcattaatgtgcatttgagtgcaagatatcttttacaaggtatgtgacatttacttttattcagtctaccactcttaattttagatattcttaaaattttcctggcatttacctgaatgggaaaagattgacctgattgaatattaggcagtaaaaattcactcttaaatggtagtaatcagaaaggtgggaactgtagatacaattgaacagtttaacatactcttagctctcttcaccttcttttaagaagctgctcaaaattgtccatatcactttggaaatattcttgttttcttgtgggaatttaaatagttcctaacagcacagtttgctatttgatagatattgttgtatcagaacctttttatttgtgtgctcgtatcaggcctggagtttaaatgggtaaaagcctttcctgctgctgttgatgccttaatactgttgaaaatgagactgtggttgattttcatcagtaccatatttcttctggaattaaagtatcacactctgagaaacaa

SEQ ID NO: 311390 - DNA, 893 bp, Homo sapiens
gccccccaaccccgcaggaaaacacaggcccctccggctttcgctctcgctctgggaactggaaggacccccgactcccgcgcagggtctggggttgtgcgcgtcgggttgcgtctccaggccgggggcgtcagggagccgggggcggggacgggcgcgggcgcagcggaccgggcggggccgagccgggaagctggtcggtgcgtcagcctcacgcggcgggaaggaaccggtccgaggccccgggctgccggcgcgggcgccgcggcacgtccacaggctgggtcgcgaggtggcgatcgctgagaggcaggagggccgaggcgggcctgggaggcggcccggaggtggggcgccgctggggccggcccgcacgggcttcatctgagggcgcacggcccgcgaccgagcgtgcggactggcctcccaagcgtggggcgacaagctgccggagctgcaatgggccgcggctggggattcttgtttggcctcctgggcgccgtgtggctgctcagctcgggccacggagaggagcagcccccggagacagcggcacagaggtgcttctgccaggttagtggttacttggatgattgtacctgtgatgttgaaaccattgatagatttaataactacaggcttttcccaagactacaaaaacttcttgaaagtgactactttaggtattacaaggtaaacctgaagaggccgtgtcctttctggaatgacatcagccagtgtggaagaagggactgtgctgtcaaaccatgtcaatctgatgaagttcctgatggaattaaatctgcgagctacaaggtgtgtacgtatacctattgatgtgtccagtatcttaatgaaaaacttgaaaaacccatttccgttgtacctactat

SEQ ID NO: 311391 - DNA, 343 bp, Homo sapiens
caaatggctacaaaggttatgattgggcttcctgggctggttcctgcagagattatggtcaaagttgttttgtcttacatggtctggccagtatttatttgtatattcagcatctcaagataaaaaacatagtatggtggtaaatgctacgtgggacagcagctttacacaaacatgtttcttaagcctatagcccacaccaatacttataaattgagctatttgtgaattaaacaaacaaaagtaaattattcatatgctcacataagttgaatcaagaaaataatatctaattgcttttttttagggaagcttggttttcttagaagtctgtctgttagcc

SEQ ID NO: 311392 - DNA, 4339 bp, Homo sapiens
  misc_feature (3718)..(3718): n is a, c, g, or t
aggctggggagaacccacagggagacccacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcactgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcggaccctgaccactttgacacagccattctgtttacccgtcaggacctgtgtggagtctccacttgcgacacgctgggtatggctgatgtgggcaccgtctgtgacccggctcggagctgtgccattgtggaggatgatgggctccagtcagccttcactgctgctcatgaactgggtcatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatgggcactgtctcttagacaaaccagaggctccattgcatctgcctgtgactttccctggcaaggactatgatgctgaccgccagtgccagctgaccttcgggcccgactcacgccattgtccacagctgccgccgccctgtgctgccctctggtgctctggccacctcaatggccatgccatgtgccagaccaaacactcgccctgggccgatggcacaccctgcgggcccgcacaggcctgcatgggtggtcgctgcctccacatggaccagctccaggacttcaatattccacaggctggtggctggggtccttggggaccatggggtgactgctctcggacctgtgggggtggtgtccagttctcctcccgagactgcacgaggcctgtcccccggaatggtggcaagtactgtgagggccgccgtacccgcttccgctcctgcaacactgaggactgcccaactggctcagccctgaccttccgcgaggagcagtgtgctgcctacaaccaccgcaccgacctcttcaagagcttcccagggcccatggactgggttcctcgctacacaggcgtggccccccaggaccagtgcaaactcacctgccaggcccgggcactgggctactactatgtgctggagccacgggtggtagatgggaccccctgttccccggacagctcctcggtctgtgtccagggccgatgcatccatgctggctgtgatcgcatcattggctccaagaagaagtttgacaagtgcatggtgtgcggaggggacggttctggttgcagcaagcagtcaggctccttcaggaaattcaggtacggatacaacaatgtggtcactatccccgcgggggccacccacattcttgtccggcagcagggaaaccctggccaccggagcatctacttggccctgaagctgccagatggctcctatgccctcaatggtgaatacacgctgatgccctcccccacagatgtggtactgcctggggcagtcagcttgcgctacagcggggccactgcagcctcagagacactgtcaggccatgggccactggcccagcctttgacactgcaagtcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcaggaaataacctcactatcccggctgccctttctgggcaccggggcctcggacttagctgggagaaagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaatctcggctcactgcatcctccgcctcccgggttcaagtgattctcatgcctcagcctcctgagtagctgggattacaggctcctgccaccacgcccngctaatttttgttttgttttgtttggagacagagtctcgctattgtcaccagggctggaatgatttcagctcactgcaaccttcgccacctgggttccagcaattctcctgcctcagcctcccgagtagctgagattataggcacctaccaccacgcccggctaatttttgtatttttagtagagacggggtttcaccatgttggccaggctggtctcgaactcctgaccttaggtgatccactcgccttcatctcccaaagtgctgggattacaggcgtgagccaccgtgcctggccacgcccaactaatttttgtatttttagtagagacagggtttcaccatgttggccaggctgctcttgaactcctgacctcaggtaatcgacctgcctcggcctcccaaagtgctgggattacaggtgtgagccaccacgcccggtacatattttttaaattgaattctactatttatgtgatccttttggagtcagacagatgtggttgcatcctaactccatgtctctgagcattagatttctcatttgccaataataatacctcccttagaagtttgttgtgaggattaaataatgtaaataaagaactagcataacactca

SEQ ID NO: 311393 - DNA, 1661 bp, Homo sapiens
  misc_feature (1040)..(1040): n is a, c, g, or t
catgctctgagtgtactcctcctccctcctgtgacccgcagggcagagggggcagtttagatggagggctgtctgtcagccccttccatccactaacccatcactgcctcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcaggaaataacctcactatcccggctgccctttctgggcaccggggcctcggacttagctgggagaaagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaatctcggctcactgcatcctccgcctcccgggttcaagtgattctcatgcctcagcctcctgagtagctgggattacaggctcctgccaccacgcccngctaatttttgttttgttttgtttggagacagagtctcgctattgtcaccagggctggaatgatttcagctcactgcaaccttcgccacctgggttccagcaattctcctgcctcagcctcccgagtagctgagattataggcacctaccaccacgcccggctaatttttgtatttttagtagagacggggtttcaccatgttggccaggctggtctcgaactcctgaccttaggtgatccactcgccttcatctcccaaagtgctgggattacaggcgtgagccaccgtgcctggccacgcccaactaatttttgtatttttagtagagacagggtttcaccatgttggccaggctgctcttgaactcctgacctcaggtaatcgacctgcctcggcctcccaaagtgctgggattacaggtgtgagccaccacgcccggtacatattttttaaattgaattctactatttatgtgatccttttggagtcagacagatgtggttgcatcctaactccatgtctctgagcattagatttctcatttgccaataataatacctcccttagaagtttgttgtgaggattaaataatgtaaataaagaactagcataacactca

SEQ ID NO: 311394 - DNA, 3036 bp, Homo sapiens
  misc_feature (2415)..(2415): n is a, c, g, or t
ggagaaaccgaaggggatcccctattagaagacttgaagcaagtttaagaaaggcccccaataccatttgcaacttgtgggctgggaagccacacgagatagcccaggctgggggatttacaggatctgatcatccacagctgcagccagatttattatggagtccctcagggcatggggaagggaccctcagatcctatcagggcctttgctcccacaggtcatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatgggcactgtctcttagacaaaccagaggctccattgcatctgcctgtgactttccctggcaaggactatgatgctgaccgccagtgccagctgaccttcgggcccgactcacgccattgtccacagctgccgccgccctgtgctgccctctggtgctctggccacctcaatggccatgccatgtgccagaccaaacactcgccctgggccgatggcacaccctgcgggcccgcacaggcctgcatgggtggtcgctgcctccacatggaccagctccaggacttcaatattccacaggctggtggctggggtccttggggaccatggggtgactgctctcggacctgtgggggtggtgtccagttctcctcccgagactgcacgaggcctgtcccccggaatggtggcaagtactgtgagggccgccgtacccgcttccgctcctgcaacactgaggactgcccaactggctcagccctgaccttccgcgaggagcagtgtgctgcctacaaccaccgcaccgacctcttcaagagcttcccagggcccatggactgggttcctcgctacacaggcgtggccccccaggaccagtgcaaactcacctgccaggcccgggcactgggctactactatgtgctggagccacgggtggtagatgggaccccctgttccccggacagctcctcggtctgtgtccagggccgatgcatccatgctggctgtgatcgcatcattggctccaagaagaagtttgacaagtgcatggtgtgcggaggggacggttctggttgcagcaagcagtcaggctccttcaggaaattcaggtacggatacaacaatgtggtcactatccccgcgggggccacccacattcttgtccggcagcagggaaaccctggccaccggagcatctacttggccctgaagctgccagatggctcctatgccctcaatggtgaatacacgctgatgccctcccccacagatgtggtactgcctggggcagtcagcttgcgctacagcggggccactgcagcctcagagacactgtcaggccatgggccactggcccagcctttgacactgcaagtcctagtggctggcaacccccaggacacacgcctccgatacagcttcttcgtgccccggccgaccccttcaacgccacgccccactccccaggactggctgcaccgaagagcacagattctggagatccttcggcggcgcccctgggcgggcaggaaataacctcactatcccggctgccctttctgggcaccggggcctcggacttagctgggagaaagagagagcttctgttgctgcctcatgctaagactcagtggggaggggctgtgggcgtgagacctgcccctcctctctgccctaatgcgcaggctggccctgccctggtttcctgccctgggaggcagtgatgggttagtggatggaaggggctgacagacagccctccatctaaactgccccctctgccctgcgggtcacaggagggagggggaaggcagggagggcctgggccccagttgtatttatttagtatttattcacttttatttagcaccagggaaggggacaaggactagggtcctggggaacctgacccctgacccctcatagccctcaccctggggctaggaaatccagggtggtggtgataggtataagtggtgtgtgtatgcgtgtgtgtgtgtgtgtgaaaatgtgtgtgtgcttatgtatgaggtacaacctgttctgctttcctcttcctgaattttattttttgggaaaagaaaagtcaagggtagggtgggccttcagggagtgagggattatctttttttttttttctttctttctttcttttttttttttgagacagaatctcgctctgtcgcccaggctggagtgcaatggcacaatctcggctcactgcatcctccgcctcccgggttcaagtgattctcatgcctcagcctcctgagtagctgggattacaggctcctgccaccacgcccngctaatttttgttttgttttgtttggagacagagtctcgctattgtcaccagggctggaatgatttcagctcactgcaaccttcgccacctgggttccagcaattctcctgcctcagcctcccgagtagctgagattataggcacctaccaccacgcccggctaatttttgtatttttagtagagacggggtttcaccatgttggccaggctggtctcgaactcctgaccttaggtgatccactcgccttcatctcccaaagtgctgggattacaggcgtgagccaccgtgcctggccacgcccaactaatttttgtatttttagtagagacagggtttcaccatgttggccaggctgctcttgaactcctgacctcaggtaatcgacctgcctcggcctcccaaagtgctgggattacaggtgtgagccaccacgcccggtacatattttttaaattgaattctactatttatgtgatccttttggagtcagacagatgtggttgcatcctaactccatgtctctgagcattagatttctcatttgccaataataatacctcccttagaagtttgttgtgaggattaaataatgtaaataaagaactagcataacactca

SEQ ID NO: 311395 - DNA, 1786 bp, Homo sapiens
aggctggggagaacccacagggagacccacagacacatatgcacgagagagacagaggaggaaagagacagagacaaaggcacagcggaagaaggcagagacagggcaggcacagaagcggcccagacagagtcctacagagggagaggccagagaagctgcagaagacacaggcagggagagacaaagatccaggaaaggagggctcaggaggagagtttggagaagccagacccctgggcacctctcccaagcccaaggactaagttttctccatttcctttaacggtcctcagcccttctgaaaactttgcctctgaccttggcaggagtccaagcccccaggctacagagaggagctttccaaagctagggtgtggaggacttggtgccctagacggcctcagtccctcccagctgcagtaccagtgccatgtcccagacaggctcgcatcccgggaggggcttggcagggcgctggctgtggggagcccaaccctgcctcctgctccccattgtgccgctctcctggctggtgtggctgcttctgctactgctggcctctctcctgccctcagcccggctggccagccccctcccccgggaggaggagatcgtgtttccagagaagctcaacggcagcgtcctgcctggctcgggcgcccctgccaggctgttgtgccgcttgcaggcctttggggagacgctgctactagagctggagcaggactccggtgtgcaggtcgaggggctgacagtgcagtacctgggccaggcgcctgagctgctgggtggagcagagcctggcacctacctgactggcaccatcaatggagatccggagtcggtggcatctctgcactgggatgggggagccctgttaggcgtgttacaatatcggggggctgaactccacctccagcccctggagggaggcacccctaactctgctgggggacctggggctcacatcctacgccggaagagtcctgccagcggtcaaggtcccatgtgcaacgtcaaggctcctcttggaagccccagccccagaccccgaagagccaagcgctttgcttcactgagtagatttgtggagacactggtggtggcagatgacaagatggccgcattccacggtgcggggctaaagcgctacctgctaacagtgatggcagcagcagccaaggccttcaagcacccaagcatccgcaatcctgtcagcttggtggtgactcggctagtgatcctggggtcaggcgaggaggggccccaagtggggcccagtgctgcccagaccctgcgcagcttctgtgcctggcagcggggcctcaacacccctgaggactcggaccctgaccactttgacacagccattctgtttacccgtcaggacctgtgtggagtctccacttgcgacacgctgggtatggctgatgtgggcaccgtctgtgacccggctcggagctgtgccattgtggaggatgatgggctccagtcagccttcactgctgctcatgaactgggtcatgtcttcaacatgctccatgacaactccaagccatgcatcagtttgaatgggcctttgagcacctctcgccatgtcatggcccctgtgatggctcatgtggatcctgaggagccctggtccccctgcagtgcccgcttcatcactgacttcctggacaatggctatgggcactgtctcttagacaaaccagaggctccattgcatctgcctgtgactttccccgaacgctgtaaactgggatcctctaagtcagctaat

SEQ ID NO: 311396 - DNA, 576 bp, Homo sapiens
taaccttcctgtcttggactattgcacctgtgtccatttattcatatcttcaaggttttatttctatcatagattagttacactgttcccattaatgtcattcttagtaaaatacctaccaatagaagaatgattgaataaacattcatagaataccctaaaaccaaagaaagaatgaagatgatttctatgtgttggtatgggagtgatctctctaagatacatcattaaagtgacaacgacaatattaaaaaaatacagtatgctactactttctgtgtaagagaggaagtaataatacataaagctactggcttttttcggaaaaaaaaaaagaaaagaaaagaaaaccagaaggataaactgaaattaattaaaaatgattacctatgagagacagagaatgggataagaaataggaagaattttaatagttttctagttaatttttacgtttaaatcaaattcaaaagataaaactgagcaaaaatgagtatttctaactttttaatatttatattttgcgtggactctcactttggttgttattcaaagtggttattacataatttcggt

SEQ ID NO: 311397 - DNA, 3438 bp, Homo sapiens
ttgtccggccctatatccggtgtccgcccgccctcggctcctccgccgtgatgctgtcccgatcccgctgtgtgtctcgggcgttcagccgctcgctctccgccttccagaagcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttctccctagtgctggtatactatagagaaacccccggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagagttattatctaaagacctggaatcaatagaaaggaatgtctgggttacagtaaggggttgtggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccacc

SEQ ID NO: 311398 - DNA, 2259 bp, Homo sapiens
  misc_feature (1380)..(1380): n is a, c, g, or t
  misc_feature (1495)..(1495): n is a, c, g, or t
  misc_feature (1596)..(1596): n is a, c, g, or t
ggctttcaccatgttggccaggatggttttgatctgttgaccttgtgatccgcctgccttggcctcccaaggggagtaatcccttggcctgtaatcctgggattacaggcgtgagcaactgcacccagcctattttttaatagtattcttgcatatataatgttaaaatagaggatgaagagtatcagtaattagaaatatgttatgtatgcatttcaatattttaaattgcctaggtgttttttttccttggaagtttacattttcttgggcttgataggtgctttgaaagtacttgctgaatttattcagtggaaacctgtgaaattgggaagggagctaagttgagccagttatctgatggacatttagggaccctgaggactagagaatagtgccttatgtcattgtgtgtgtgtctcatagtgctttgcatattgctgatacccagtagacattcgttacttgattggagctagagtttttgccactaaattttgcttggttgcttctcatttcagacagtgccagtggcatatacttttcttgtttttcagctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctggtaggcttccaactcccacatgtcatgtgggagaacatctcgtctaatatgttccttcaaagggtaaactctagactgatgatggttctgaacaggccaggttggctgctttgtagaaagaattctagactttgtatccaaaggcctgctttgcatctcagctttctgttactagctgtgtgtctttaggctagtcacttaatttatctgaacagattgttcatctgtgaagttggagtgatactaatatacctcagaatatcttgaagattaagtaacagtacatatgaaagcactggcacaaactcagcagatgtttctttccttgtctgatgcagctttatcctcttttcattttcagtgtctgcagtaaaacccactgttgccccaccactagctgagccaggagctggcaaaggtctgcgttcagaacatcgggtaagctctgaggaccactttcaggaaagaggcagggggcagtgttgagattagtggagtatgggtgtggtgatgcctacctttgaatgcctggcagctcattccctcaaccttgataaagggagtttaggatataacttcttcatagtcacataaccatcaaatgataggactagaacctgaggtcttctgaacacttgttcagtggttttcctactatattatgctaccngtgaaagccttgggtaagttaaatatttgtaggggtggtagcttagtaactcaccccgtcctccacgatgtcacacgttcagagaggtggtttagtgagctctattcctatactnctgggatacttagctgtagctaagggataatactcagtagcaatagctgtcaggtgcagacataaagcctcaaggaagtatggtcaggattgtggttcctntgcctgagaatacttcctaaaaatatgatagcctcgaaagtttgttgctcatgaggttctgttccacaaatagctattcttatgcaaatctttatcaacagaaagtgccctttttcttatgattcttatgttggctagactacactacactacattcttttataaatgggttttggtttttaaatcactgtttctgagccttcattcttggtcaagctttaggcacatctgagtgagtagttttggcctgtgtttgcatgtttttgcttggaggagaaagggccaccacaggaaagggaagcctggagctcgtgtacttagatactgtagtccttggccatctactcgtggcaagccgtgttctttctgactacacggggaatgcttgacccagagagatcagattgtcaatgcttgttccactcttactttcaggagaaaatgaacaggatgcggcagcgcattgctcagcgtctgaaggaggcccagaatacatgtgcaatgctgacaacttttaatgagattgacatgaggtagtgtctctagtccctcttatcccctaggcccctttttcttagagaacacgaacttgccccactccttatctagtgctgattctaaaactaacttgtcagggaagaggtatttgtttattgttttttg

SEQ ID NO: 311399 - DNA, 2823 bp, Homo sapiens
ttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttctccctagtgctggtatactatagagaaacccccggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctca

SEQ ID NO: 311400 - DNA, 642 bp, Homo sapiens
atgtcaaagactcttgtcattccagctgcccttagttgagggaataaggggtaaatttatatatagtgtgaacttcaaatgtcaaattctaaaagaaaagtgtattttttaaaaaataaaccttatactctgttctttccatgggtgtttcttagcaggagctgagaaactggaccttttcttatagatatacagattgagcatacctaatctgaaaattcaaaatctgaaatgctccaaaactgaaaatccaaaatctgaaatgcttcaaaactttttgagcactgacagaatgctcaaaggaaatgctcattgtcttttatggggaattcagtgttgtttcttttcacatctgttctctcatatctctaggaagggttggtatttcttttgggaagaaatgagaaacgaatttgtactggacctgataggattagagattaataactttatctgactcttagttaaattttataaccactaaaaagtctatttctttttcctaagcgagaatcgtacccgtagaccaacgagtcacagaagtctatttctttttcactgttacactaataaggcagatagaccgcatgattgaggttagtcaggcaagaccagaagctcagagtagaaaacatgtatggt

SEQ ID NO: 311401 - DNA, 388 bp, Homo sapiens
aaccctttccaacccctttgctggttgctgggcctcattctagcaccttgttcttagagcagattctagctgagccaggagctggcaaaggtctgcgttcagaacatcgggagaaaatgaacaggatgcggcagcgcattgctcagcgtctgaaggaggcccagaatacatgtgcaatgtgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctca

SEQ ID NO: 311402 - DNA, 3521 bp, Homo sapiens
ttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttctccctagtgctggtatactatagagaaacccccggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagagttattatctaaagacctggaatcaatagaaaggaatgtctgggttacagtaaggggttgtggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccacc

SEQ ID NO: 311403 - DNA, 3472 bp, Homo sapiens
ttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctgcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttctccctagtgctggtatactatagagaaacccccggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagagttattatctaaagacctggaatcaatagaaaggaatgtctgggttacagtaaggggttgtggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccacc

SEQ ID NO: 311404 - DNA, 3586 bp, Homo sapiens
ggctttcaccatgttggccaggatggttttgatctgttgaccttgtgatccgcctgccttggcctcccaaggggagtaatcccttggcctgtaatcctgggattacaggcgtgagcaactgcacccagcctattttttaatagtattcttgcatatataatgttaaaatagaggatgaagagtatcagtaattagaaatatgttatgtatgcatttcaatattttaaattgcctaggtgttttttttccttggaagtttacattttcttgggcttgataggtgctttgaaagtacttgctgaatttattcagtggaaacctgtgaaattgggaagggagctaagttgagccagttatctgatggacatttagggaccctgaggactagagaatagtgccttatgtcattgtgtgtgtgtctcatagtgctttgcatattgctgatacccagtagacattcgttacttgattggagctagagtttttgccactaaattttgcttggttgcttctcatttcagacagtgccagtggcatatacttttcttgtttttcagctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttctccctagtgctggtatactatagagaaacccccggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagagttattatctaaagacctggaatcaatagaaaggaatgtctgggttacagtaaggggttgtggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccacc

SEQ ID NO: 311405 - DNA, 1291 bp, Homo sapiens
ttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaaacttgccttgagatatgggttggcgaccttcacattacaagggggcggttgggcgcgctttggaaacctttttaacccctcaagttgcaccgggggaggtgggcttaaagggcccgctattaggcagaaaagtgggccccattattgggacataaaccggagattga

SEQ ID NO: 311406 - DNA, 851 bp, Homo sapiens
ctgcctcccaggttcaagtgattctcctgcctcagcctcccgaatagctgggattacaggtgcccaccaccatgcctggctaagttttttgtatttttagtagagacagggtttcaccatgttggtcaggctggtctcaaactcctgacctcaggtgatctgcccacctcagcctgccacaaagtgttgggattacaggcctgagccactgcgtgagccactgcgcctggctcctctcacttcttaagtttaagtgctatctaaaattctcccctcccctcaggatagttgtagaatttatagctctgccgttttctttacatatgtactttctgctggccctgtaggaaagggttcttataacatacctgccaaaatgggttttgtggctactggaggctccccgctaacaggtagccttgtagcctttgattgtcttttcagctgttggagacacagttgcagaagatgaagtggtttgtgagattgaaactgacaagacatctgtgcaggttccatcaccagcaaatggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctca

SEQ ID NO: 311407 - DNA, 877 bp, Homo sapiens
gcaagcaactatgtagcagtacgatacctggctgttatatcagtgcgaggcgccgtctgcatctttcaacgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctca

SEQ ID NO: 311408 - DNA, 399 bp, Homo sapiens
cttcattggagattctatacagctaattttctaatgctggataaacatttggacttcctccatctgtcttcctcttccagacaacatctgtgcaggttccatcaccagcaaatggcgtgattgaagctcttttggtacctgatgggggaaaagtcgaaggaggcactccacttttcacactcaggaaaactggtggtaaagaagttctcctggtggtcaaggtctccagtgttccctcttgggattgggactgagcataatgtgctaattccccgatatgtcaaagactcttgtcattccagctgcccttagttgagggaataaggggtaaatttatatatagtgtgaacttcaaatgtcaaattctaaaagaaaagtgtattttttaaaaaataaacc

SEQ ID NO: 311409 - DNA, 3465 bp, Homo sapiens
ttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttctccctagtgctggtatactatagagaaacccccggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagagttattatctaaagacctggaatcaatagaaaggaatgtctgggttacagtaaggggttgtggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccacc

SEQ ID NO: 311410 - DNA, 3377 bp, Homo sapiens
ttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttctccctagtgctggtatactatagagaaacccccggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagagttattatctaaagacctggaatcaatagaaaggaatgtctgggttacagtaaggggttgtggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccacc

SEQ ID NO: 311411 - DNA, 2227 bp, Homo sapiens
ttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttctccctagtgctggtatactatagagaaacccccggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggccaatactgagtgcctgcagcatctactactctgtcttcactattcagaacttgtaactaaagtatttaaagaaactgattttaaatgcaaattaaagggcagatattctca

SEQ ID NO: 311412 - DNA, 3641 bp, Homo sapiens
ctgcctcccaggttcaagtgattctcctgcctcagcctcccgaatagctgggattacaggtgcccaccaccatgcctggctaagttttttgtatttttagtagagacagggtttcaccatgttggtcaggctggtctcaaactcctgacctcaggtgatctgcccacctcagcctgccacaaagtgttgggattacaggcctgagccactgcgtgagccactgcgcctggctcctctcacttcttaagtttaagtgctatctaaaattctcccctcccctcaggatagttgtagaatttatagctctgccgttttctttacatatgtactttctgctggccctgtaggaaagggttcttataacatacctgccaaaatgggttttgtggctactggaggctccccgctaacaggtagccttgtagcctttgattgtcttttcagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttctccctagtgctggtatactatagagaaacccccggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagagttattatctaaagacctggaatcaatagaaaggaatgtctgggttacagtaaggggttgtggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccacc

SEQ ID NO: 311413 - DNA, 3416 bp, Homo sapiens
ttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctgcattaacaacagtgtcttcagtgttcgctttttcagaactacagctgtatgcaaggatgacttggttacagtcaaaaccccagcgtttgcagaatctgtcacagagggagatgtcaggtgggagaaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttctccctagtgctggtatactatagagaaacccccggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagagttattatctaaagacctggaatcaatagaaaggaatgtctgggttacagtaaggggttgtggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccacc

SEQ ID NO: 311414 - DNA, 3540 bp, Homo sapiens
ttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagcctttgattgtcttttcagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacacaaccaaagaggtggtgtatagggattatattgacatcagtgttgcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttctccctagtgctggtatactatagagaaacccccggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagagttattatctaaagacctggaatcaatagaaaggaatgtctgggttacagtaaggggttgtggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccacc

SEQ ID NO: 311415 - DNA, 2602 bp, Homo sapiens
  misc_feature (30)..(30): n is a, c, g, or t
  misc_feature (58)..(58): n is a, c, g, or t
  misc_feature (81)..(81): n is a, c, g, or t
  misc_feature (88)..(88): n is a, c, g, or t
cagtttctttaaatactttagttacaagtnctgaatagtgaagacagagtagtagatnctgcaggcactcagtattgacancagtgtngcagtggccaccccacggggtctggtggttccagtcatcaggaatgtggaagctatgaattttgcagatattgaacggaccatcactgaactgggagagaaggcccgaaagaatgaacttgccattgaagatatggatggcggtaccttcaccattagcaatggaggcgtttttggctcgctctttggaacacccattatcaacccccctcagtctgccatcctggggatgcatggcatctttgacaggccagtggctataggaggcaaggtagaggtgcggcccatgatgtacgtggcactgacctatgatcaccggctgattgatggcagagaggctgtgactttcctccgcaaaatcaaggcagcggtagaggatcccagagtcctcctcctggatctttaggaggaacccacacaccctacaagttgatcatgcaggaactgaaaaccagtcttctccctgtcccctcatgggtcccgggttagcctggtgacaggcagacacatgctgttggcctcaagcaaggaagcagagcactgtgtaaccagcagtcacaggtcttttcttggcgttcctgccaggctctccctctctgcacctgtctcatagcctcgaatatcttaattccttaggcttaagagagagagccttaatggatgctcattcatattcctgcctttcttccatcagctctctgcaaagatgattttgcttctccctagtgctggtatactatagagaaacccccggggaccatgtgattaagttcctatcttttgaaagtttgttctgcagagacttctaggaggatgctgtgcctcccaagctcagagcagcctctgtcctggctgtgcacattctcccttgattccacttgtgtggagggattgaacacaggcaaagaggtgctgctttgcttcttcaatggcaccttcattctccgttgtcattgacttcaagatgcctcttctacctcttccaggaagcacaggccaggggatctgggtgtgtgagtgggaggagagggcagaggtcccctgaggtcatgcattgtaatcatcatagaaggagagcccaggcctgccctcacgctctccatcataggctgacaccaagaagactcgtcttggcacaatctcacacagctggggctgtagcaaccctttccaacccctttgctggttgctgggcctcattctagcaccttgttcttagagcagattctagcacatcatggcagtgggaccaagcgtggtcccgaggaagggccagagcctggtagagactagggaagggaggtctcctctagactgactcacattgccttgagcttttcagttaagttgctgtaagcacctgggctgaggaggcagtttttgttccttcctgcgttatagcggggccttgtctcttcctctgcaggacacagatctggaggacgtggactggggtaggaaaccaccctgagggtgttagtacctagtggtgaaacggatgaggtcatttctaaggtgtgttgcccgtggatctgggcacaatcattggaattccttggagccactgggattcatggctttgtatccaactgcatccaggcctgaggctgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctcaaacagggttcctgtatctgttccttttggctactgaggtggtacaagtccccagcactgttgcactgaaattattgaaagccactcaaggtcctgttgcttattttgtgaaatcagaaatcccttatgtggaacttaacactcataatttgacagaaggtagaaccctgactgccagccgggaaagtgttgccaaaaagagtcaacctctgtaaaaatatttgaagagatttattctgagccaagtgtgagtgactgatggcctgtgatacaactcttaggagatcctgagaacatgtgtccagggtcgtctggctacaacttagttttatacatttaatacattttagggagacataagataccagtcagtacatgtaagatgtacagtggtttggtctggagaggcaggacagctcaagacctggggatgttgtcataggcagaatcaaagattttctgattggcaattggttgaaagagttattatctaaagacctggaatcaatagaaaggaatgtctgggttacagtaaggggttgtggagaccaaggttttatgcagatgaagcctccagccagcaggcttcagagaaaatagattgtaaatgcttctcatcagacttaaggagcctgttttaacagtaattccaaaagggaggggagtataatgaggaatggctggctccctcttcccacc

SEQ ID NO: 311416 - DNA, 1335 bp, Homo sapiens
ttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgtctgcagtaaaacccactgttgccccaccactagctgagccaggagctggcaaaggtctgcgttcagaacatcgggagaaaatgaacaggatgcggcagcgcattgctcagcgtctgaaggaggcccagaatacatgtgcaatgctgacaacttttaatgagattgacatgagtaacatccaggagatgagggctcggcacaaagaggcttttttgaagaaacataacctcaaactaggcttcatgtcggcatttgtgaaggcctcagcctttgccttgcaggaacagcctgttgtaaatgcagtgattgacgacaaacaaagaggtggtgtaatagggatatatcgatcaggtgcagggcaaacccaaggggtcgcaggaccacgcaccagagaacacgcgccaaccacatgaaactacaggaaccacactggacaggaacaacacagcaagcgcgcccacacagggccgacccaacagcaactgccaccgcaccatggaggagggccaccaccacaacacacgaccgcgctcaggcgcacaagaaacaaccagcctcaacaacacaacagcacaaggagacgctaactcgacgcaacaccaaacagcccgcacccaacaacccacgcataaagccaaccaacccacaaaaggaacccctaccacccgggcaaccaactacacaaca

SEQ ID NO: 311417 - DNA, 854 bp, Homo sapiens
ttgtccggccctatatccggtgtccgcccgccctcggctcctccgccgtgatgctgtcccgatcccgctgtgtgtctcgggcgttcagccgctcgctctccgccttccagaaggggaactgccctctagggagacgttccctgcctggggtctccttatgccagggaccaggttaccctaacagcaggaaggttgtcattaacaacagtgtcttcagtgttcgctttttcagaactacagctgtatgcaaggatgacttggttacagtcaaaaccccagcgtttgcagaatctgtcacagagggagatgtcaggtgggagaaagctgttggagacacagttgcagaagatgaagtggtttgtgagattgaaactgacaagacatctgtgcaggttccatcaccagcaaatggcgtgattgaagctcttttggtacctgatgggggaaaagtcgaaggaggcactccacttttcacactcaggaaaactggtgctgctcctgctaaggccaagccggctgaagctcctgctgctgcagccccaaaagcagaacctacagcagcggcagttcctccccctgcagcacccatacccactcagatgccaccggtgccctcgccctcacaacctccttctggcaaacctgtgctgacgtttgacaccagggccagtagagagtgcccttttgtatcttaagccaagaagtgaggcctgggggtgggggaggggggaaggggtgggagccaatactgagtgcctgcagcatctactactctgtcttcactattcagaacttgtaactaaagtatttaaagaaactgattttaaatgcaaattaaagggcagatattctca

SEQ ID NO: 311418 - DNA, 1621 bp, Homo sapiens
gaaaaattagctaggtcgaggcccgggtgtgaatcggccgaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311419 - DNA, 1139 bp, Homo sapiens
ggtcctgtctcagctgtctgagctggcagcaagcccacccagtagctacttttctggagcagtaggcactgcatgcctggagctcaggaacacttcgtgtatctccttagggccaaagctaggattcccagacccttttttccagcactgatggtttcctaggagtttactttggctctacagccctgggttggatgggtcaggttaatgtatgcaactttgaaggggcccaagaaagactcaaccagagaaaaaaatgagatttatttcattactggaatgaagcaattcttcgtacaggtaattatagttcgcagcttttcaggggaaactgggtcaaggttggaaaataaccaagtaaaaagtattttctgacgttatcataagttcagcaaaatagctaaggataatccaaacatgttagtagatttttctaaatgtcctcttatctacttaggagaatggaatgtcgtgacacttgaattggtgccatgccttagcatgagggcccgcctgtttttggtgtccatttaaggtggtaatgatacgagtttttaagttaaaatggcacttaaggtgtcttttttttttttatctttttcatccaaaataggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagaggtagactttctcatacttattttgccttgtttagtagggaacaccgcatagctcttctcttgagaatgggcaatctcagggggctctccctatggccacagttcttgctgtgcgtggccttccatgcatgctttaggctctgctctcccaggagccagctaacaactgcccagtaactgtgaacgtctggagagactggtcagttatgaataaccatgtcttgagcacccgccctgatccaggaccatctggactctagggacacagttgtgagcacaagtctctgccctggaggagctcacaggttgtagggatcagataccaaacatggaaa

SEQ ID NO: 311420 - DNA, 378 bp, Homo sapiens
agatttttacttatttttgttgaaagcaagatattgtcatgttgccaattagtaaatatgctaataatttcagtaaagcctttcattcatactgtttttcataggaatctgtggagcttcctctcacccatcctgaatattatgaagagatgggtataaagcctcctaagggggtcattctctatggtccacctggcacaggtatgctctgtttttgacactttccaggcacccagctggtctcttgagcagcagcattggctagttataattactgaactaataagagaggacaccacaattccttagtttaaaacagggctgctcaaccttgtctgcatgttggaatcaccttgggagctttaaaaatactgatgg

SEQ ID NO: 311421 - DNA, 2271 bp, Homo sapiens
gaaaaattagctaggtcgaggcccgggtgtgaatcggccgaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggttaaatttgctttggtttcatcatggagattaatgtgtttatatatttgtgtttaagtgtgctttgggaggcctataaaatgatacataaaaaagcaaatactgcagtgaaacttaggataatttacaaaaaaataggtcctcttgagatgagggttaaaacagagcatgatatggtctgtgcaccttggccctttgaattccagtcttatgtcttgtcttttcttttccataacattccctttttagcctcaagaacttgctgctttttctggaagaaataattcatgtgatggtaggatttgtcctttttacattcaggtagcatcagaagaaacagtgatttgtttgctgtcttttgtaatgtttttaacacaataggtctgcccagtttcactcaggaattgctcctttcatttatttctgaaggtatcaaagcagagagagtttcttttaaatgaagagaattcaaatgtagaaatctacaaactacaaaaatatatgtttactttttaaaatttagacatccttcccacagaattctgtccgactgaaacttcgtatgtaaggagatgggctgaggcctctgagccatggccgagcctggggtttggatgttggtgtgacttcaaatctctttgtacctgcaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311422 - DNA, 1568 bp, Homo sapiens
gaaaaattagctaggtcgaggcccgggtgtgaatcggccgaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagtgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311423 - DNA, 1567 bp, Homo sapiens
gaaaaattagctaggtcgaggcccgggtgtgaatcggccgaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311424 - DNA, 1572 bp, Homo sapiens
cgcattcagctagtacgagcccggctgagagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311425 - DNA, 1578 bp, Homo sapiens
aaacttcggctaggtacgaggcctgggtgtgtggcagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311426 - DNA, 1579 bp, Homo sapiens
aaaataatgtcataggtcgagtgctgggtgttattacgatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311427 - DNA, 1572 bp, Homo sapiens
tggctgtaccggcccgaatctttggatgcagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311428 - DNA, 1570 bp, Homo sapiens
  misc_feature (21)..(21): n is a, c, g, or t
  misc_feature (23)..(23): n is a, c, g, or t
cgcgttacctccgcatgggcnanggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311429 - DNA, 1297 bp, Homo sapiens
gaaaaattagctaggtcgaggcccgggtgtgaatcggccgaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagaggtagactttctcatacttattttgccttgtttagtagggaacaccgcatagctcttctcttgagaatgggcaatctcagggggctctccctatggccacagttcttgctgtgcgtggccttccatgcatgctttaggctctgctctcccaggagccagctaacaactgcccagtaactgtgaacgtctggagagactggtcagttatgaataaccatgtcttgagcacccgccctgatccaggaccatctggactctagggacacagttgtgagcacaagtctctgccctggaggagctcacaggttgtagggatcagataccaaacatggaaa

SEQ ID NO: 311430 - DNA, 1408 bp, Homo sapiens
ctgcccacgaagtgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311431 - DNA, 1387 bp, Homo sapiens
ctgacttggattgactgctgtgttgggaatccactgcagggagatgaggctgaagtcagggagacaggtaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311432 - DNA, 1561 bp, Homo sapiens
gaaaaattagctaggtcgaggcccgggtgtgaatcggccgaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311433 - DNA, 1463 bp, Homo sapiens
ggtcctgtctcagctgtctgagctggcagcaagcccacccagtagctacttttctggagcagtaggcactgcatgcctggagctcaggaacacttcgtgtatctccttagggccaaagctaggattcccagacccttttttccagcactgatggtttcctaggagtttactttggctctacagccctgggttggatgggtcaggttaatgtatgcaactttgaaggggcccaagaaagactcaaccagagaaaaaaatgagatttatttcattactggaatgaagcaattcttcgtacaggtaattatagttcgcagcttttcaggggaaactgggtcaaggttggaaaataaccaagtaaaaagtattttctgacgttatcataagttcagcaaaatagctaaggataatccaaacatgttagtagatttttctaaatgtcctcttatctacttaggagaatggaatgtcgtgacacttgaattggtgccatgccttagcatgagggcccgcctgtttttggtgtccatttaaggtggtaatgatacgagtttttaagttaaaatggcacttaaggtgtcttttttttttttatctttttcatccaaaataggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311434 - DNA, 909 bp, Homo sapiens
tgcggttgactctagcaggatccctcataggttcgcaggtgtgatggtaggatttgtcctttttacattcaggtagcatcagaagaaacagtgatttgtttgctgtcttttgtaatgtttttaacacaataggtctgcccagtttcactcaggaattgctcctttcatttatttctgaaggtatcaaagcagagagagtttcttttaaatgaagagaattcaaatgtagaaatctacaaactacaaaaatatatgtttactttttaaaatttagacatccttcccacagaattctgtccgactgaaacttcgtatgtaaggagatgggctgaggcctctgagccatggccgagcctggggtttggatgttggtgtgacttcaaatctctttgtacctgcaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311435 - DNA, 1033 bp, Homo sapiens
gaaaaattagctaggtcgaggcccgggtgtgaatcggccgaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaagcacgaatctgtggagcttccatctcaacacatgctgactattatgacaagagatgggtcataaaagctccctaaagggcggtcatccctctatagagtcccaacctggacacacgcgtaaaaaaccattagtaagaccaaacgcagtacgcaaaccaaaagcctcaaggccagagttatctctgaggaagatgggttgggcgtcatgaaactaatttcagaaaacgtaccgtaagggtgaatgaggccaaaaacctgagtaaggggaaatgggtcccgaacatggtgaagaaaacgatgaaacacgacaaacggagataaatagataaaattgaggcgatagggaaaagaaagatatgc

SEQ ID NO: 311436 - DNA, 553 bp, Homo sapiens
tagtagagatggggtttcaccgtgttggccaggctggtcttgaactcctgaccttaggcgatccacctgcctcggcctcccagagtgctgggattacaggtgtgagccaccgcgcctggcctcagaataggttttttggaattccttgttagaataaaaatgagtatgtcactttctgaacacactcttctttcttacaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311437 - DNA, 466 bp, Homo sapiens
gaaaaattagctaggtcgaggcccgggtgtgaatcggccgaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagagaggaaagatcaaaagttggaatggaaatttcccttttttgtggaaaaaaaggggggggggggggctctctttctttaaaaaaatcatgccatcgtggtctacatttg

SEQ ID NO: 311438 - DNA, 140 bp, Homo sapiens
aagaaaacaaagggaccagatgctgccagcaaactgccactgggtaatgacatggcttctccttgccatctttccagttcttaggataaaccatctctgtgcatgtagcttagagtctgaaaggggtaacaggaagtaga

SEQ ID NO: 311439 - DNA, 620 bp, Homo sapiens
gccgcctactactactaaattcgcggccgctcgactgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311440 - DNA, 2269 bp, Homo sapiens
gaaaaattagctaggtcgaggcccgggtgtgaatcggccgaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaacacttcctgtttctgcagtctccacacacacctaccgctcaacagcagcctgtgggtggacccagctacagggaagcctttggacaggaactcaggctgcggtcccaaggagtgtggacctcactatgcgttcgccacatcacacccccagagctggcgttcaacggtaattacagtgggaaatggtcactaccacagagccagggatattcgttgtttaaataataaaggctgcgttaatgtggctattgcttccaaaggaagtacagctttcctttttggaagttttgtggaccatgcatgttcttagcactctgagggcagaaaataactactggtgttcccaagagactgaggattcctagagatatcttgaaagcccttctgagcccttgggctcagaaatctcatccctttcaaggtgttcagaaacatgtcagaacttccccttccctttctccgtctatttccgtcatttctctttctgaacaaatcaggcctaaagctattaagtgggacagatcaaggtaagcgttcccttgacaggtggcctggtgtgggttgtagggcccacactgaatgaggagtgtgcattagttttctgttaatactataacaacaacactccaacaggggatcctcagagtcga

SEQ ID NO: 311441 - DNA, 1624 bp, Homo sapiens
acaacagcccaccacacagacaaaaaaggctagtgcgagccggcgtgatcggacgaggcggcagctcagtggtcaagggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311442 - DNA, 1578 bp, Homo sapiens
tggtacgcctccggatggttacgggatccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311443 - DNA, 1570 bp, Homo sapiens
taggctagtacgggctggtggtgaatcggccgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311444 - DNA, 1592 bp, Homo sapiens
aataaaaaaaacaatcggcagaggaggctggggtaatcggccgaggggcagacgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311445 - DNA, 2023 bp, Homo sapiens
gaaaaattagctaggtcgaggcccgggtgtgaatcggccgaggaacttccggcagcggcagctcaagtggccaaggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggttaaatttgctttggtttcatcatggagattaatgtgtttatatatttgtgtttaagtgtgctttgggaggcctataaaatgatacataaaaaagcaaatactgcagtgaaacttaggataatttacaaaaaaataggtcctcttgagatgagggttaaaacagagcatgatatggtctgtgcaccttggccctttgaattccagtcttatgtcttgtcttttcttttccataacattccctttttagcctcaagaacttgctgctttttctggaagaaataattcatgtgatggtaggatttgtcctttttacattcaggtagcatcagaagaaacagtgatttgtttgctgtcttttgtaatgtttttaacacaataggtctgcccagtttcactcaggaattgctcctttcatttatttctgaaggtatcaaagcagagagagtttcttttaaatgaagagaattcaaatgtagaaatctacaaactacaaaaatatatgtttactttttaaaatttagacatccttcccacagaattctgtccgactgaaacttcgtatgtaaggagatgggctgaggcctctgagccatggccgagcctggggtttggatgttggtgtgacttcaaatctctttgtacctgcaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggtgagagcctagccgtgtcagcttatttctgggaatgtggccgtcaatcaggaaagagtctatatgtgctcttgggatggtggttggcctggacaggtgggtgtc

SEQ ID NO: 311446 - DNA, 1565 bp, Homo sapiens
agagagagagagagagagtcagagatgagagatgagtaggatcataggatcacgtggaagagtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaggaaagatcaaaagtggatgatctgagggggaccccgatgtcagtaggaaccttggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311447 - DNA, 1513 bp, Homo sapiens
  misc_feature (21)..(21): n is a, c, g, or t
  misc_feature (23)..(23): n is a, c, g, or t
cgcgttacctccgcatgggcnanggcaagatgggtcaaagtcagagtggtggtcatggtcctggaggtggcaagaaggatgacaaggacaagaaaaagaaatatgaacctcctgtaccaactagagtggggaaaaagaagaagaaaacaaagggaccagatgctgccagcaaactgccactggtgacacctcacactcagtgccggttaaaattactgaagttagagagaattaaagactatcttctcatggaggaagaattcattagaaatcaggaacaaatgaaaccattagaagaaaagcaagaggaagagattattgatgacaatcatgccatcgtgtctacatctgtgggctcagaacactacgtcagcattctttcatttgtagacaaggatctgctggaacctggctgctcggtcctgctcaaccacaaggtgcatgccgtgataggggtgctgatggatgacacggatcccctggtcacagtgatgaaggtagaaaaggccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311448 - DNA, 1031 bp, Homo sapiens
tcggtacccccaatcaacatccaagccccccaggagacctatgcagatattggggggttggacaaccaaattcaggaaattaaggaatctgtggagcttcctctcacccatcctgaatattatgaagagatgggtataaagcctcctaagggggtcattctctatggtccacctggcacaggtaaaaccttgttagccaaagcagtagcaaaccaaacctcagccactttcttgagagtggttggctctgaacttattcagaagtacctaggtgatgggcccaaactcgtacgggaattgttccgagttgctgaagaacatgcaccgtccatcgtgtttattgatgaaattgacgccattgggacaaaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311449 - DNA, 1170 bp, Homo sapiens
tgtatttcccacagttctggaggctgagaagcccaagatcaaggcactggcattgatgtctagtgagggctgctctctgcttccgagatggcacctattctgcagaggagacaaatgctcaggggacaaacaaaagagcaaaaagggcctacactagttccctgcagcattttttataaggaatacatgctgtataaggcctttttctctttttagaaggaactcatgctgtataaggctctgcctcatgcctttagccctttccaaaaggcctcatctcttagccacacagtagggattaagtttcaacacataaatttggggaaatacattcagaccatggcaaggggtgctgaatttattttttccgagcataattgagggagtgccatgtgagttgaaacaggaatgtttgttaaggtgttttgtcacaatgaggtctttgctgtaattccccttgagcaggcgatcagttgagtcttcattccttccctttttttttttccaaagatatgactccaattctggtggtgagagagaaattcagcgaacaatgttggaactgctgaaccagttggatggatttgattctaggggagatgtgaaagttatcatggccacaaaccgaatagaaactttggatccagcacttatcagaccaggccgcattgacaggaagattgagttccccctgcctgatgaaaagacgaagaagcgcatctttcagattcacacaagcaggatgacgctggctgatgatgtaaccctggacgacctgatcatggctaaagatgacctctctggtgctgacatcaaggcaatctgtacagaagctggtctgatggccttaagagaacgtagaatgaaagtaacaaatgaagacttcaaaaaatctaaagaaaatgttctttataagaaacaggaaggcacccctgaggggctgtatctctaatgaaccatggctgtcatcaggaaaatggttgggagatttctcaatccctgaaagggatgaggttgggggagttgcccagaggaatccctgttcccactgatttttattagcaaaacatcctgtgtcttttggagtacgatgtgtaagtgcccattgggtggcctgttggtcactgtgcagcagtctgcttcccaataaagcgtgctctttcacaaaca

SEQ ID NO: 311450 - DNA, 932 bp, Homo sapiens
tgagcaaggctcagcctcaagattcacagcatctcagacgcagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311451 - DNA, 899 bp, Homo sapiens
tgagcaaggctcagcctcaagattcacagcatctcagacgcagcctaggccgcaccaggatgtcggacaccgaggagcaggaatatgaggaggagcagccggaagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311452 - DNA, 640 bp, Homo sapiens
tgagcaaggctcagcctcaagattcacagcatctcagacgcagcctaggccgcaccaggatgtcggacaccgaggagcaggaatatgaggagagaggaggctgcggaggaggaggaggaagcccccgaagagccggagccggtggcagagccaggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311453 - DNA, 798 bp, Homo sapiens
atgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaagcagaacagaagcgtggtaagcggcagatccgctagcctcggggatcctgctagagatcgaccatcag

SEQ ID NO: 311454 - DNA, 407 bp, Homo sapiens
accctggcccctgactcataaacattcatcagctcccccatgaacaccctgcactcgcccccaaatatcagctcccacatgtcagcgaggctttgaccaccagccgctgccccccagtcatagaacccaaaagaggtgacagttgttttgctcactgcttcctctgggcagggagggctaatattttggggaatgggcttcctgaattgagggcctggggcccatttcagagactggaggggcccctttttcctgataccacctcattcttctacagccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311455 - DNA, 260 bp, Homo sapiens
tgagcaaggctcagcctcaagattcacagcatctcagacgcagcctaggccgcaccaggatgtcggacaccgaggagcaggaatatgaggaggagcagccggaagaggaggctgcggaggaggaggaggaaggaagaggacagaggccaagaagcggggagaggatgcgcaccttcatctcccgcccggtgcgttacgagtctgtctgctgaaaggacgcaacgggcccctgtgaaagcctctaaccggatatctactgc

SEQ ID NO: 311456 - DNA, 1070 bp, Homo sapiens
atgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311457 - DNA, 1024 bp, Homo sapiens
ccccagctcctcctctctcacacccaggagtccagacccaggagtccaggcccccagcccctcctccctcacacccaggagtctaggtcgccccctccttggggccccaccccactgggcctcttctctctggtccttaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311458 - DNA, 1104 bp, Homo sapiens
gcttaggctaggtagaggctgggtgttaatcggccgaggggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311459 - DNA, 1241 bp, Homo sapiens
gcttaggctaggtagaggctgggtgttaatcggccgaggggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagcccccgaagagccggagccggtggcagagccagaagaggaacgccccaaaccaagcccgcctcagctgggaccctccacgttcaggagcctcccggggctggcggctacctcactggacggcacatcccggaggtgggaggtggctcagggaggtcgggccactcatggtctctgtgtttctggccactcagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311460 - DNA, 800 bp, Homo sapiens
cgactacatacttcctggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311461 - DNA, 1037 bp, Homo sapiens
atgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311462 - DNA, 1066 bp, Homo sapiens
tgagcaaggctcagcctcaagattcacagcatctcagacgcagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacaacccgctgggttctctgatgttattatggttgagatgcagctggtctctcctggttaattgacttcttattaccaacaagttacttgaaagagtgtcaccaataatcattaaagtacggcaggctgaaccttca

SEQ ID NO: 311463 - DNA, 1226 bp, Homo sapiens
tgagcaaggctcagcctcaagattcacagcatctcagacgcagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacataaaaaaaacaaaaaaaaactaaaccaaaaacaacatgtgccgacacggaccagcgcccacaaaacagcctacaaagaacaacgctaaagggcgacgcagcggcaccaaagactacagacgcaacggcgcacagcgctggcacagaaggagagaccggagccgacgcaaagggcgcggaaccgaccaaaaaaaaagcccggcgggaacgcgcagcctgagaaacaccaaaaggaaccagagggccagaggggatccacaagaggcgacaagagcgatataatcccccgacgggg

SEQ ID NO: 311464 - DNA, 932 bp, Homo sapiens
tgagcaaggctcagcctcaagattcacagcatctcagacgcagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttactgcgtctcgctctgtcacccaggctggagtgcagtggagtgatctcagctcactgcaacttccatctcccgggttcaagcgattctcctgcctcagccccctgagtagctgggattacaggtgcgcgc

SEQ ID NO: 311465 - DNA, 887 bp, Homo sapiens
gcttaggctaggtagaggctgggtgttaatcggccgaggggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagaagaggaacgccccaaaccaagccgccccgtggtgcctcctttgatcccgccaaagatcccagaaggggagcgcgttgacttcgatgaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaaccgcatagcacgccagaaggttcggaagggggcaggaagggccgcgttggaggcgctgaagtgagatgcgcccgaccgtggacctggaacctggatgttgccatcgcgggctgaataagcgccctcagaaaaaaaaaaagggggggtctaaaacccggggcccg

SEQ ID NO: 311466 - DNA, 1081 bp, Homo sapiens
gcttaggctaggtagaggctgggtgttaatcggccgaggggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagaagaggaacgccccaaaccaagcccgcctcagctgggaccctccacgttcaggagcctcccggggctggcggctacctcactggacggcacatcccggaggtgggaggtggctcagggaggtcgggccactcatggtctctgtgtttctggccactcagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcgctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacaacccgctgggttctctgatgttattatggttgagatgcagctggtctctcctggttaattgacttcttattaccaacaagttacttgaaagagtgtcaccaataatcattaaagtacggcaggctgaaccttca

SEQ ID NO: 311467 - DNA, 895 bp, Homo sapiens
gcttaggctaggtagaggctgggtgttaatcggccgaggggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagcccccgaagagccggagccggtggcagagccagaagaggaacgccccaaaccaagcccgcctcagctgggaccctccacgttcaggagcctcccggggctggcggctacctcactggacggcacatcccggaggtgggaggtggctcagggaggtcgggccactcatggtctctgtgtttctggccactcagccgccccgtggtgcctcctttgatcccgccaaagatcccagaaggggagcgcgttgacttcgatgtaagtgacaagagacccctccgcaggcgcagttgctagtctttaaggggcctttgtgtcaatcatgaaaaggcgccggccgggcgcggggcctcatgcctgtaatcccagcactttgggaggctgaggtgacccacctgaggtcaggagttcgagaccagcctggttaatatggtgaaaccccgtctctactaaaaatacaaaaattagccgggcgtggtggcaggtgtctgtaatcccagctactcgggaggctgaggcaggaaaatcgcttgaacctgggaggcggaggtggcggtgagccgagatcgcgccatttcactccagcctgggag

SEQ ID NO: 311468 - DNA, 1114 bp, Homo sapiens
tgagcaaggctcagcctcaagattcacagcatctcagacgcagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggcccggtctgcctggctgcctccatcacagccctcctgccctgccagggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacaacccgctgggttctctgatgttattatggttgagatgcagctggtctctcctggttaattgacttcttattaccaacaagttacttgaaagagtgtcaccaataatcattaaagtacggcaggctgaaccttca

SEQ ID NO: 311469 - DNA, 509 bp, Homo sapiens
tcagacacagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcgaggagaagatgaggaaggaagaggaagcagcactaaaagcactctgagtcaagatgagtgggaaaccatctcaataaacacattttggataaaaaa

SEQ ID NO: 311470 - DNA, 1103 bp, Homo sapiens
atgggatggggacacgcccaggagctcttgggaggggaggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311471 - DNA, 1071 bp, Homo sapiens
tgagcaaggctcagcctcaagattcacagcatctcagacgcagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggttcaagcgaatcttctgcctcagcctccccagtagctgggactacaggatattaagacccagagaagggggccaggtgcggtggctcacgcctgtaatcccagcactccgggaggccgaggcaggcggatcacttgaggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311472 - DNA, 1075 bp, Homo sapiens
  misc_feature (950)..(950): n is a, c, g, or t
  misc_feature (953)..(953): n is a, c, g, or t
  misc_feature (967)..(967): n is a, c, g, or t
  misc_feature (972)..(972): n is a, c, g, or t
  misc_feature (974)..(974): n is a, c, g, or t
  misc_feature (977)..(977): n is a, c, g, or t
tgagcaaggctcagcctcaagattcacagcatctcagacgcagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagacaaaaaaaaaaaaaaaaatnaanagaaaggacacaanaaatntnccnaaagggttaaaaataattacaggtggcttttaaattttttccttgagggggggggccccggcaacccaatatttcgccctttataggggaggtcggtt

SEQ ID NO: 311473 - DNA, 1208 bp, Homo sapiens
gcttaggctaggtagaggctgggtgttaatcggccgaggggcgaggagtgtggcactttggcggggaaggggcggctcagccctcgggccctcgcccgccctctccgggtctggagcgtctcctcgcgccatccctgcaccgccagggggaacgtgcccatcgcagccgaggccagagggacccccgtccagcagagactggaaccctggtctctggccaccgcccccatccctcccccagctcctaacgccttctcttctgtgcccccatctccagaggaggctgcggaggaggaggaggaagcccccgaagagccggagccggtggcagagccagaagaggaacgccccaaaccaagcccgcctcagctgggaccctccacgttcaggagcctcccggggctggcggctacctcactggacggcacatcccggaggtgggaggtggctcagggaggtcgggccactcatggtctctgtgtttctggccactcagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311474 - DNA, 1353 bp, Homo sapiens
tgagcaaggctcagcctcaagattcacagcatctcagacgcagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatgtagtcaatgtccagaggcttcttacgctcggagaggatgcgcaccttcatctcccgccccgtctgccgcttaccacgcttctgttctgccttgaccaggtagccgccaaatgggcccccatgttggacagcaccttctttttcttggcatcatcctctgcccgcttcttggcctcttcctcttccttcctcatcttctcctccgccagcttagcctgacgttcgcgttccttctcagttctgaagcgctgttgctcggctctctctgaccggcgccgctcaatgcgctccttcaaggcaaccagctcctcttcctccttcttccgctgctcgaaatgtacatcgatgagtgtctgcagctccagcaggtctttctccatgcgcttgcggtggatgtcatcgaagtcaacgcgctccccttctggatctttggcgggactagttctagatcgc

SEQ ID NO: 311475 - DNA, 980 bp, Homo sapiens
tgagcaaggctcagcctcaagattcacagcatctcagacgcagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaaggcagaacagaagcgtggtaagcggcagacggggcgggagatgaaggtgcgcatcctctccgagcgtaagaagcctctggacattgactacatgggggaggaacagctccgggcccggtctgcctggctgcctccatcacagccctcctgccctgccagggagaaagcccaggagctgtcggactggatccaccagctggagtctgagaagttcgacctgatggcgaagctgaaacagcagaaatatgagatcaacgtgctgtacaaccgcatcagccacgcccagaagttccggaagggggcagggaagggccgcgttggaggccgctggaagtgaggatgccgccccggacagtggcacctgggaagcctgggagtgtttgtcccatcggtagcttgaaataaacgctcccctcagaca

SEQ ID NO: 311476 - DNA, 627 bp, Homo sapiens
tgagcaaggctcagcctcaagattcacagcatctcagacgcagcctaggccgcaccaggatgtcggacaccgaggagcaggaatatgaggaggagcagccggaagaggaggctgcggaggaggaggaggaagcccccgaagagccggagccggtggcagagccagaagaggaacgccccaaaccaagccgccccgtggtgcctcctttgatcccgccaaagatcccagaaggggagcgcgttgacttcgatgacatccaccgcaagcgcatggagaaagacctgctggagctgcagacactcatcgatgtacatttcgagcagcggaagaaggaggaagaggagctggttgccttgaaggagcgcattgagcggcgccggtcagagagagccgagcaacagcgcttcagaactgagaaggaacgcgaacgtcaggctaagctggcggaggagaagatgaggaaggaagaggaagaggccaagaagcgggcagaggatgatgccaagaaaaagaaggtgctgtccaacatgggggcccattttggcggctacctggtcaagcagaacagaagcgtggtaagcggcagatccgctagcctcggggatcctgctagagatcgaccatcag

SEQ ID NO: 311477 - DNA, 1494 bp, Homo sapiens
agaaaaaagtccgggagagactagctcagatctgatctgtaccacctgggggttcccagcccatagctctgtaggccttcaaggaggaagaggaggggaagggggggaaggggctgaggctcggggactccagcctgaagtccaagcatgtgcggaagcctagaccctcccaccttaccacaaacttggctccaagtcccctctatgctgacgcatccttgccctcctcctcctccccactgccctccactagcccatcctccctcctccctcctcccctcgacacacatttatcactagtgacatctcagccccccctaccccaatccagggacacaggagggacacagtagggttagactgagggccactgatgtggcttcaccctcagtgcttgggcaattcccaagttacagcatctcagtccccagagaaggccatgctgccactgtagccgccaagggccccctggagtgcagggcacagaggaggaagggagaggatgtgagctgcaggaggcagctgaagccaagccttgggcaggctctcaggtattacatacctggtggggaggagggttctcccttccctaggctggatccctcacttgctcctagtgcctggaaccttaggtttagagagccactctactccttgaagtctcttgatgcaccttacctggggccctttccttatccctctctgcagcattcccagagatggtccactggagggtttcagcaccacagagaggctgatgattcacaaatctcatgcagttacacctcattccttctgacagcaatttgaaggggctgaaagggggctaatccctaaggaccagtggttggtagcctacgtaagactccctggtgggtaaatttcactcagaccatttgctgtgatctacgaatctcctatatgcctttctaaactcaactctgtgcttagactctggtacattccactgcagccataccagcctatgctgtccctctaacacgtgtacaacacacaagccatgccctgtttggaatgttcttccccaaaatatcactgccagtgaccttgcttcaggtctttattcaaaaactgacctcatccttaccctgatattccagaataccattctgctttattatttgtcttccacacttagcactattcaacataaagcactagaatataagctccacgagggtggaaacttttgctcttatttgctgttctattctgcagcacatcaaacagtgcctggcacacagcaggtgctcaataaatatttattaaatgaatatgttcaggatgctcagaggaagatcccaccaatcatcaaaccaggaaggaagggatctggtctccacttgtgtgtggctgagatgtgttctgagatggcccagtgtccgagttttattccctcacctactgagaacagggacctgccctttgacagctgaatcttgggaggcaacagtctgatgcaaaaaaaaaaaa

SEQ ID NO: 311478 - DNA, 608 bp, Homo sapiens
gctgtacccctcggttttcgggatggctccctcccggcaaccccgccggtcctctcagagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgtaagtcctcagggatggggcaggatccccagaactcccagggaaggaggggacaacagaaaggcttcgagggaatggccaccatgggaaggagccagcttgctgtgatagtgtcaggaataagtggacctgccagagacccagggccagcccactctgggcctgtccactggctctgcaattctctggtccttaaagcctcagtctgtcagtctctctggggttggcaaaaaaaaaaaaaaagtaaaagtggagaaacggg

SEQ ID NO: 311479 - DNA, 2838 bp, Homo sapiens
agcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccaggatattggagttactctatcctggagttaactaggatagag

SEQ ID NO: 311480 - DNA, 2774 bp, Homo sapiens
agcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaacttatttccttttttttggtaatcccccccttttccgacaacccggctttgttcataaaggccccgtggggaaccggag

SEQ ID NO: 311481 - DNA, 1695 bp, Homo sapiens
acagggacccaaaaccatggaacaggtggtctgggaaaccttccctgatgaagcaaattagctgagacccaggggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccagga

SEQ ID NO: 311482 - DNA, 2696 bp, Homo sapiens
acgtctcccttccgagggccgccgggggctgcgggcgcgcggagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccagga

SEQ ID NO: 311483 - DNA, 2586 bp, Homo sapiens
agcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccagga

SEQ ID NO: 311484 - DNA, 370 bp, Homo sapiens
ctcccaaagctcactgattgggagctgggggtaggggacaatcacagaatctctgcctctggggcagagtcctttctcctatggtgttttggcctcattttctccatctgaaaagtttccccaccttcaaaattctgggcctgagacaagaggtgcccctaatgtcttgactttctcctgttcacaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggat

SEQ ID NO: 311485 - DNA, 373 bp, Homo sapiens
gatctcagtttccctacctgcatctgggtagaagccatggccctctggctggagctttaatttgtatctttggttatctgtctatcccagggcagtgcaggacaggcgggacagcccggaagtccaggccaccagggcctagcggtaagtgtcaggtggagccacaggggctggccaggggctagtggctgatgaggttagaatccacacacacccggggctcttgctcaatcaccacctcttgccttgttaccaactctgtggcccctggcctggcgaaggcttcattacttggacaattactctagccttctctttggccattccagtcctccatgttggctaaatgggatctgaccatttctgcactata

SEQ ID NO: 311486 - DNA, 900 bp, Homo sapiens
tcctgccctgcagtctggaatagagctgctgcccaactcgctcatcccccttcacgtttctctaaaagccccaaccttcctcccacacgtgcccaaatccaagaggcatcagcttggagcccccagccctggtagtgggtctcacagctggcacctcatgacatcagcatgtctgtaccttcttgcatgttgctgtcaccctctccagcccggccagggttattctcatgctcctgtgatttgtttttggtttttatttttgaggaaaagggggctcttttcccaaagattgcaaggcttaggggacctggacagaagagaggagagtgaggagagcctttgggagcggcctgccagggcctgtgtgtgcccacttggggtagtgtgagccgtagtgtgctgtctcaccaacttgtatcttgcagggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgtaagtcctcagggatggggcaggatccccagaactcccagggaaggaggggacaacagaaaggcttcgagggaatggccaccatgggaaggagccagcttgctgtgatagtgtcaggaataagtggacctgccagagacccagggccagcccactctgggcctgtccactggctctgcaattctctggtccttaaagcctcagtctgtcagtctctctggggttggcaaaaaaaaaaaaaaagtaaaagtggagaaacggg

SEQ ID NO: 311487 - DNA, 2799 bp, Homo sapiens
agcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccagga

SEQ ID NO: 311488 - DNA, 3244 bp, Homo sapiens
agcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccaggaaaaaaaaaaaaaaaaaaaaaaaaaaaaaaaaaaaaaaaaaaaaaaaaaaaaaaaaaaaaaaaagggggggggcgcgccgcaaaagaccccccggggggggcgccacacgtagtatccagcgcgagacacccaccgtttcttgtgtggtaacacagggggcgccccaattagggggaggcgcgactaatctataaagcgccgcggcggcggcagcgcgcgcggtcttacaacaccacgccatgcggacgcgggcggaacaaaacgcggcccccgccgggggagaccaccctgtggaggaacaaggaccacccccacctctctgcggcgggggcgggagcagcccaactagggggagcaccaacacctcctcccccacggagatacttctaccacgcccccccaggagcggcccattactaactccccttccacgcgggtgcttccg

SEQ ID NO: 311489 - DNA, 2731 bp, Homo sapiens
tatagccgccgacagacaaggagctgctgttcagtccgccggccgcagctcacagcgaggcctcatccccctcctctcctttcccctccttgtggggtaggaggcgactcaacccctcaccctgcctctggcacatctggacgcttcttcagggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccagga

SEQ ID NO: 311490 - DNA, 3004 bp, Homo sapiens
tcctgccctgcagtctggaatagagctgctgcccaactcgctcatcccccttcacgtttctctaaaagccccaaccttcctcccacacgtgcccaaatccaagaggcatcagcttggagcccccagccctggtagtgggtctcacagctggcacctcatgacatcagcatgtctgtaccttcttgcatgttgctgtcaccctctccagcccggccagggttattctcatgctcctgtgatttgtttttggtttttatttttgaggaaaagggggctcttttcccaaagattgcaaggcttaggggacctggacagaagagaggagagtgaggagagcctttgggagcggcctgccagggcctgtgtgtgcccacttggggtagtgtgagccgtagtgtgctgtctcaccaacttgtatcttgcagggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagggccgggatgccactgaccagcacatcgtggatgtggcgctgaagatgctgcaagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccagga

SEQ ID NO: 311491 - DNA, 2676 bp, Homo sapiens
tatagccgccgacagacaaggagctgctgttcagtccgccggccgcagctcacagcgaggcctcatccccctcctctcctttcccctccttgtggggtaggaggcgactcaacccctcaccctgcctctggcacatctggacgcttcttcagggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccgggtcccaagggagatgtgggtgcctctggagagcaaggcatccctggaccaccgggtccccagggcatcaggggctacccaggcatggcagggcccaagggagagacgggccctcatggatataaaggcatggtgggcgctatcggtgccactgggccaccgggtgaggaaggtcctaggggaccgccaggccgagctggggagaagggtgacgagggcagcccaggtattcgtggaccccaggggatcacaggcccgaaaggagcaacgggccccccaggcatcaacggcaaggatgggaccccaggcacgcctggcatgaagggcagtgcaggacaggcgggacagcccggaagtccaggccaccagggcctagcgggtgtgccaggccagcctgggacaaaaggaggccctggagaccagggtgagccgggcccgcagggccttcctggattctctggtccccctgggaaagagggagagccagggcctcgaggagaaattggtccccagggcatcatgggacagaagggtgaccaaggcgagaggggtccagtggggcaaccaggccctcagggaaggcagggccctaagggggagcagggcccccccggaattccagggccccaaggcttgccaggcgtcaaaggagacaagggctccccagggaagaccgggccccgcggcaaagtgggtgacccaggggtggccggcctccccggagagaaaggcgagaagggcgagtccggcgagccggggcccaagggacagcaaggagtacgtggagaacccggctaccctggccccagcggggatgcgggcgccccaggggttcagggctaccctggtccccccggccctcgaggactggccgggaaccgaggcgtgccaggacagcccgggagacagggcgtggagagcaactggcagaggtcgccgtgagtgccaagcgggaagccctgggtgcggtgggcatgatgggtcctccaggacctcctgggccccctgggtacccaggcaagcagggcccccatgggcaccctggccctcggggcgttcctggcatcgtgggagccgtgggtcagatcggcaacacggggcccaagggaaaacgtggagagaagggtgatccaggagaagtgggacgggggcaccccgggatgcctgggcccccagggatcccaggactccctggccggcctggccaggcaatcaacggcaaggatggagatcgagggtccccaggggctccaggagaggcaggtcgacctggcctgccaggccccgtggggctgccgggcttctgtgaacctgccgcctgccttggagcttcggcctatgcctctgcccgccttacagagcctggatccatcaaggggccttgagcatcaggcccagacagagcctggcaggcatcctggcgggaaggaccaggtcccctctgggtggacatgcacccatccccagtccaggaaaccatctcccccaggaccttctgtctgggactcaggagtcctaaggaaaaggaattctaaaacatgggggaaggggaggtagagcactgatgggtgaaaaagtgaggccaacacacagggcaagtggtgtcgatggagtcgaagcgctgaaggaatagggcggctttccttccagcgagcatcattcggctgttaccaaaacaaacatcttaatctgcacctttctccactggccatcttgtccttgggtcagtgggacatgggcacctcgggaggcccgggccctgcccagctacagttccacccctcagcttgaggaccaatgactgaggtctatgccagttcctgatcccatctcactctctggacctaccaggtgactgctgctgggtgactcccctgaggcggctatacccttaagccagccccactacttccttccctgcctcccagctcagtatttaaacatcatctcccttctctttctcgcataactccccacccctttctccccgatccacccaggcctttctgtaaataaaagctcccaagttgggtacaaaccagga

SEQ ID NO: 311492 - DNA, 1573 bp, Homo sapiens
agcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacggtgacaatgggccccctggaaaagctggccctccgggacccaagggcgagcctggcaaagctgggccagatgggccagacgggaagcccgggattgatggtttaactggagccaagggggagcctggccccatggggatccctggagtcaagggccagcccgggcttcctggtcctcctggccttccgggccctggttttgctggacctcctgggcctcctggacctgttggcctccctggtgagattggaatccgaggccccaagggggaccctggaccagatggaccatcggggcccccaggaccccctgggaaacctggtcgcccgggaaccatccagggtctggaaggcagtgcggatttcctgtgtccaaccaactgtccacccggaatgaaaggtcccccagggctgcagggagtgaaggggcatgcgggcaaacgcgggattctgggtgatcctggccaccaggggaagccggtgagtgcaagggctgaggagccactctactccttgaagtctcttgatgcaccttacctggggccctttccttatccctctctgcagcattcccagagatggtccactggagggtttcagcaccacagagaggctgatgattcacaaatctcatgcagttacacctcattccttctgacagcaatttgaaggggctgaaagggggctaatccctaaggaccagtggttggtagcctacgtaagactccctggtgggtaaatttcactcagaccatttgctgtgatctacgaatctcctatatgcctttctaaactcaactctgtgcttagactctggtacattccactgcagccataccagcctatgctgtccctctaacacgtgtacaacacacaagccatgccctgtttggaatgttcttccccaaaatatcactgccagtgaccttgcttcaggtctttattcaaaaactgacctcatccttaccctgatattccagaataccattctgctttattatttgtcttccacacttagcactattcaacataaagcactagaatataagctccacgagggtggaaacttttgctcttatttgctgttctattctgcagcacatcaaacagtgcctggcacacagcaggtgctcaataaatatttattaaatgaatatgttcaggatgctcagaggaagatcccaccaatcatcaaaccaggaaggaagggatctggtctccacttgtgtgtggctgagatgtgttctgagatggcccagtgtccgagttttattccctcacctactgagaacagggacctgccctttgacagctgaatcttgggaggcaacagtctgatgcaaaaaaaaaaaa

SEQ ID NO: 311493 - DNA, 680 bp, Homo sapiens
  misc_feature (1)..(1): n is a, c, g, or t
ngagacagtgcctcactctgtcacccaggctggagtgtagtggcatgatctgggctcactgcaacctcctcctcctggattcaagcaattctcttgcttcagcctcccaagtagctgagactacaagcacccaccatcacacccagctaattttgtatttttcagtagagacggggtttcgccacattggccgtgttggtcttgaactcctggcctcaagcgatccgcctacctcagcctcccaaagtgctaggattacaggcataagccactgagcccagccctagttcagtatcttttatgtaaattacaaacatctgcaacattatgtatcatatgcagatacttattgcatttcttttattagtggtgaaagtgttctatgcatttattggctcttgaatttcctcatctatgaattgtcattcatacacctacttttctgcttcgtttttacatatgtctttgcctattaaagatattatccctctgttttatattttctctcattcttgtattgccttttaaattttgttatgatgtttcattaataaacagtgttttgttttcctctataatcaaatctagattttccctttgtgatttccgacaccacttccattcttagaagtacttttccattcataaagtagtaaaataaaatagttttttctctaaac

SEQ ID NO: 311494 - DNA, 3544 bp, Homo sapiens
gagcgcagcagcagggccgggtcctgcgcctcgggggtcggcgtccaggctcggagcgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattctttacctgtctgccctcatgatttgccagcatgaattcatgatgctccacactcgcttatgctacttaatcagaatcttgagaaaatagaccataatgattccctgttgtattaaaattgcagtccaaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatctttttttttttttttttctgagacgcagtctggctctctgtcgcccaggctggagtgcagtggctcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtgtcgatctcctgacctcgtgatccacccgcctcggcctcccaaagtgctgggattacaggcttgagccaccgcgcccggctatattttatcttttatctttttctttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggatttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttatagcacaatttatttatccactcattcattgatggactttgggttgtttctgacttttggctattgggaatagtgctgctatgaatgtttgtgtacctgtatttgtttgaatgcctattttgcattctcttgggtatatatctaggagtggaactgctgggtcatatgttaattctatgtttagctttttgaggaacagacaaactgttttccacagcagttgaaccattccacattcccaccagcaatgtatgagaattccaatttctgtccacttcctcaccaacacttattattttccttttcctttttttaaaaaaaataagttatggccatcttagtgggtgtgaagtggtatctcattgtgttttttatttgcatttcctatgtaatgagctagaaactaaagtacaaactagatgggacatccagtccctttgatagataatgctgagtaaaaaatgagatgaaagacatttgtttgtttttagaacacgagtgacagtttgttaaaaagctttagaggaggaatgaaaacaaagtgaagtacacttagaaaagggccaagtggacatcttggatgtcaagtgcctagttcagtatctttttttttttttttt

SEQ ID NO: 311495 - DNA, 3199 bp, Homo sapiens
gagcgcagcagcagggccgggtcctgcgcctcgggggtcggcgtccaggctcggagcgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattctttacctgtctgccctcatgatttgccagcatgaattcatgatgctccacactcgcttatgctacttaatcagaatcttgagaaaatagaccataatgattccctgttgtattaaaattgcagtccaaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatctttttttttttttttttctgagacgcagtctggctctctgtcgcccaggctggagtgcagtggctcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtgtcgatctcctgacctcgtgatccacccgcctcggcctcccaaagtgctgggattacaggcttgagccaccgcgcccggctatattttatcttttatctttttctttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttctcctggcctcaagcgatccgcctacctcagcctcccaaagtgctaggattacaggcataagccactgagcccagccctagttcagtatcttttatgtaaattacaaacatctgcaacattatgtatcatatgcagatacttattgcatttcttttattagtggtgaaagtgttctatgcatttattggctcttgaatttcctcatctatgaattgtcattcatacacctacttttctgcttcgtttttacatatgtctttgcctattaaagatattatccctctgttttatattttctctcattcttgtattgccttttaaattttgttatgatgtttcattaataaacagtgttttgttttcctctataatcaaatctagattttccctttgtgatttccgacaccacttccattcttagaagtacttttccattcataaagtagtaaaataaaatagttttttctctaaac

SEQ ID NO: 311496 - DNA, 1751 bp, Homo sapiens
gagcgcagcagcagggccgggtcctgcgcctcgggggtcggcgtccaggctcggagcgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattctttacctgtctgccctcatgatttgccagcatgaattcatgatgctccacactcgcttatgctacttaatcagaatcttgagaaaatagaccataatgattccctgttgtattaaaattgcagtccaaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatctttttttttttttttttctgagacgcagtctgggcaacagagcgagactctggcttgaaaaaaataat

SEQ ID NO: 311497 - DNA, 3578 bp, Homo sapiens
aacacagccacaacagggaaaggaagagacccgcgggggtttaaaattcagagcacggaaggtgggcctgggttagggtcaggctcggagcgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattctttacctgtctgccctcatgatttgccagcatgaattcatgatgctccacactcgcttatgctacttaatcagaatcttgagaaaatagaccataatgattccctgttgtattaaaattgcagtccaaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatctttttttttttttttttctgagacgcagtctggctctctgtcgcccaggctggagtgcagtggctcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtgtcgatctcctgacctcgtgatccacccgcctcggcctcccaaagtgctgggattacaggcttgagccaccgcgcccggctatattttatcttttatctttttctttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggatttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttatagcacaatttatttatccactcattcattgatggactttgggttgtttctgacttttggctattgggaatagtgctgctatgaatgtttgtgtacctgtatttgtttgaatgcctattttgcattctcttgggtatatatctaggagtggaactgctgggtcatatgttaattctatgtttagctttttgaggaacagacaaactgttttccacagcagttgaaccattccacattcccaccagcaatgtatgagaattccaatttctgtccacttcctcaccaacacttattattttccttttcctttttttaaaaaaaataagttatggccatcttagtgggtgtgaagtggtatctcattgtgttttttatttgcatttcctatgtaatgagctagaaactaaagtacaaactagatgggacatccagtccctttgatagataatgctgagtaaaaaatgagatgaaagacatttgtttgtttttagaacacgagtgacagtttgttaaaaagctttagaggaggaatgaaaacaaagtgaagtacacttagaaaagggccaagtggacatcttggatgtcaagtgcctagttcagtatctttttttttttttttt

SEQ ID NO: 311498 - DNA, 1664 bp, Homo sapiens
ccttcctccagcccccagcaaccaccaatctgctttctgtctctatggatttatctattcatgctatttaatataaatcgaattgtatgagaccttttgtgtctggcttctttcacttagtacaagtttttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggatttatctattcttgctattttatataaatcgaattgtatgagaccttttgtgtctggcttctttcacttagtacaagtttttgagatttatttacatagtagcatgtatcaacacttcatttttatggccaaataaaattgtattatgtgtttatagcacaatttatttatccactcattcattgatggactttgggttgtttctgacttttggctattgggaatagtgctgctatgaatgtttgtgtacctgtatttgtttgaatgcctattttgcattctcttgggtatatatctaggagtggaactgctgggtcatatgttaattctatgtttagctttttgaggaacagacaaactgttttccacagcagttgaaccattccacattcccaccagcaatgtatgagaattccaatttctgtccacttcctcaccaacacttattattttccttttcctttttttaaaaaaaataagttatggccatcttagtgggtgtgaagtggtatctcattgtgttttttatttgcatttcctatgtaatgagctagaaactaaagtacaaactagatgggacatccagtccctttgatagataatgctgagtaaaaaatgagatgaaagacatttgtttgtttttagaacacgagtgacagtttgttaaaaagctttagaggaggaatgaaaacaaagtgaagtacacttagaaaagggccaagtggacatcttggatgtcaagtgcctagttcagtatctttttttttttttttt

SEQ ID NO: 311499 - DNA, 273 bp, Homo sapiens
gtaagacccgggctgcgggaagaacccagggacacctttgcgggcagaactcgagtgccacttccacctctcatattcaccttctgagttggcgatgcggcagacgcacactgtgcaggcacttggcgttgggatcgaacttttgttcaaggctgacttttcccaatattgtctgcgtgatctgccaaactacacatctcagtcctctgttttttcatcgctagaaggagtgggcggcggttaaaatgccttttaaaataaatcaggtaggag

SEQ ID NO: 311500 - DNA, 238 bp, Homo sapiens
gatgcaagattttatcacaacctcttttctgagcttttctcacccttgtcattttttgtgtgttactgatctttaaacaagcgagatccattcaggcagaatggctacatcttttactcgcctgttttctgtcccctctctctcctctccccagccatcaaagagctatcttgataacttttaaaattatctttcacaacaggcactgtctttaaacacagaggaagacattcatcgg

SEQ ID NO: 311501 - DNA, 580 bp, Homo sapiens
cttctgacatgtccatgtatagtcacagaatgttagaactgggtgtgatcatgaagggttggatcaaacactccaattaaccatgtgagacaaacaccccttcagcctatcacatttcctgctggtcttgttctccaacctggtgtaatttttctactttgtaccaacctgctttcctcgagtgacttaggtatctttcaccatcctcaacttggtggatgttctcaaggtgtcagtaatcatgaataccactcatatgtgctgtttttatttctctacataacaacccaaactcagcaaagttgaaaacagaagtttgcttctcaactaatgatccaggatcatccaatgcatcaggttcttataaaaagcaactgaatgtagtctctacttttcttgaaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggtgggggaagctttttaaaatcctgctagtttga

SEQ ID NO: 311502 - DNA, 515 bp, Homo sapiens
ctcctctgcgccaattatgcttagtaccaccaggaacatttccatttctgtgaataaatgagacggtaaagaatgggagacgttcttcgcttaaagtctcagcagttgtttcccgcattcctgcttggagtatttaccacggatgctctcttcaggcagtgggttagcagggatgccctcagttcattgaaacagtaccacttgatctccagggaaagaaggggtgatctttgtttgcccacatcctcttttccagggatgcctagtgctttgttgaggggattcagcaggaatatctcctccaaaagcttctggaaactccccatgtgcccaatgtcagctcttcccgctttgagccgtccattctggttgcttctgacatgtccatgtatagtcacagaatgttagaactgggtgtgatcatgaagggttggatcaaacactccaattaaccatgtgagacaaacaccccttcagcctatcacatttcctgctggtcttgttctccaacctgg

SEQ ID NO: 311503 - DNA, 1618 bp, Homo sapiens
gagcgcagcagcagggccgggtcctgcgcctcgggggtcggcgtccaggctcggagcgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattctttacctgtctgccctcatgatttgccagcatgaattcatgatgctccacactcgcttatgctacttaatcagaatcttgagaaaatagaccataatgattccctgttgtattaaaattgcagtccaaatcccataggatggcaagcaaagttcttctagaattccacatgcaattcactctggcgaccctgtgctttcctgacactgcgaatacattccttaacccgctgcctcagtggtaataaatggtgctagatattgctacta

SEQ ID NO: 311504 - DNA, 991 bp, Homo sapiens
acttctccagcctccctgatgagggaaaaatgctttctctaagcaattctgattttaattaataccaatccaggggatgtcaggaacgacatctacattactctcttacaaggtgactttgacaagtacaacaagaccacacagaggaatgtggaagtcatcatgtgtgtgtgcgcggaggatggcaaaacgctgcctgtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgcatgagttgctgaagtggcgtatgacgcctcaactggaagaatcatgagacggtcttgaatcatcacaatctgatgaaagccactacaaatacccatccttatgcaggtgggggctttgaaatacattccatgtggttctgcatgatgtagcaaatggaactgatgggaaggtaccagaccagtctgtatgagtgacgacggagccctctgggaactccgaagcgaacgtacgcatacatcaagagcaacgcagccttaaaagacgaggcgggaaatggcagtgatccaagaacagaagactgacaaaggaagagacgctgaaaaaaggacacgagaaacgcccagagggcactaccatgacgacagggagacaaaggatatgggaggtcaacgaggaaacacacacgtcactacatgtcacaa

SEQ ID NO: 311505 - DNA, 3418 bp, Homo sapiens
ggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaagagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccagctgtggaacaactattttcatctggcagtggcttttatcacccaggattctctgcagctggagcagttctcacacgccaaatacaacaaaatcctgaataagtatggggacatgagacggctaattggcttctccatccgtgatatgtggtacaagcttggtcagaacaaaatctgcttcatcccaggcatggtaggacctatattagagatgacacttatccctgaggctgagctccggaaagccaccataccaatcttcttcgacatgatgctgtgtgcttccgggggatcctcatagagtcgcgc

SEQ ID NO: 311506 - DNA, 3551 bp, Homo sapiens
ggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaagagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccaggccctattcaggatgctggtccttggtgtctgcatcagttcatgtggtcagggaagaccaagagaggatttcaaattcaaatcagcaggtatttttgtttaagagcaattcttatgggcccagactattgcaacatgcttcaaggaactcagaagcaaagaacactgccctaccctcaaggatcttggaatcttgatagaaggctatacaaatccatcttccagcatccaggcttttgaagagggtgactaactttattgggcatctacttagaaaattttgattctcatcataatcttgtcaggttgtgatatacccatttccctggtgaataaactgagcttcagagaattgattgacttttctgttaaaggtcatctaaccaataaatggggctgctgcgattcaaccccaggcctgtctgcaaagcacatcctcttt

SEQ ID NO: 311507 - DNA, 2976 bp, Homo sapiens
ggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaagagatcatggtccagctgctgcggacagtgaaccggacagtcatcaccatgggccgggatcacattctgattaacccagctcgaaccctttaacctctgcccatcgtgctttaaaccaaggacccaaaattcaaatgctttcaggggccagtcaccaacataaatgagtatgcccaaccatgtcactcctctgctgaaacctgccaatggt

SEQ ID NO: 311508 - DNA, 551 bp, Homo sapiens
cattatagtagattccctcataccccttctcagccagtagtcccccggggtaatcactgtcctgacaaccatcattgtagatgggtttttgcctactctcaaatttcataagaatggaatagtgaagagtgtactttctgtgcctgatgtattttactgcatataatgcttgtgagaatcatcctcatttctgcctgtggaagtagtttgcactttagtccagctgtgtagtattctctagtgtgaacatgccaccatctgtgcatccattctgctgttgatgggcagttgggttcctccaacttctggctctcgtgagtaaaactactctagacgttttgagcatgacatgtggtggatgtgtgctctcattctcttatagatagttaggagtgggattgctggttcacctgtactttgtcttgtttctgaagtagtgcaacctttgttatttcttccagtttctccaggatactctggatgccctcttcaacatcatgatggagcattctcaaagtgatgaatatgacatcctcgtctttgatgccttg

SEQ ID NO: 311509 - DNA, 418 bp, Homo sapiens
tgtaggggggtgcagtggggagggccctttaactcattgtgttctgagctctgtttctgtctgctgaggtggctgtccctattgaagacatgcagaggatccatctgcgattcatgtttcgacatcggtcatctctggaatgtgagtaccatactgaatggcatctctgcacctccccctaaggggagaagaatggaagagctgggtggcccatgtatcattttctttcctgaccccacaatgctatttccagctaaagataaaggagaaaagaactttgccatgtcctatgtgaagctgatgaaagaagatgggactactctacacgatggattccatgacttagttgtcctcaaggtaccatgagttggaaggagctctgcactgaggggagtgcaggaagaaagggggtgatggc

SEQ ID NO: 311510 - DNA, 6052 bp, Homo sapiens
  misc_feature (3494)..(3494): n is a, c, g, or t
ggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaagagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccagctgtggaacaactattttcatctggcagtggcttttatcacccaggattctctgcagctggagcagttctcacacgccaaatacaacaaaatcctgaataagtatggggacatgagacggctaattggcttctccatccgtgatatgtggtacaagcttggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaagtttgaaaacgaaatcatcctgaagctggaccacgaggtagaagggggccgaggcgacgagcagtacatgcagctnctggagtcaatcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcactgtgaacctgctgaatttctacaaagataacaacagggaggagatgtacataaggtacctgtacaaactccgcgatcttcacctggactgtgacaattacacagaggctgcctacacgctccttctccacacctggcttctcaagtggtcggatgagcagtgtgcatcacaggtcatgcagacaggccagcagcacccccagacacaccggcagctgaaggagacgctctacgagaccatcataggctactttgacaaaggaaagatgtgggaagaggccataagtctgtgcaaggagctggcggaacagtacgagatggagatctttgactatgagctgctcagccagaacctgatccagcaggcaaaattctatgaaagcatcatgaaaatcctcaggcccaaaccagactactttgctgttggatactacggccagggattcccctccttcctgcggaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtatatccagtgcttcactgtccagcctgtcttggatgaacatcccaggttcaagaataagccagtgcctgaccagattataaacttctacaaatccaactacgtgcaaaggttccactactcccggcccgtgcgcagggggaccgtagacccagagaatgagtttgcttccatgtggattgagagaacctccttcgtgactgcatacaagctgccggggatcctgcgctggtttgaggtggtgcacatgtcgcagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcaagaacctgaaaatgaaggtggagaaggagtacggtgtccgagagatgcctgactttgacgacaggagagtgggccgtcccaggtctatgctgcgctcatacagacagatgtccatcatctctctggcttccatgaattctgactgcagcacccccagcaagcctacctcagagagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcggctttccaggaagcatgagttcatgagtgacaccaacctctcggagcatgcggccatccccctcaaggcgtctgtcctctctcaaatgagctttgccagccagtccatgcctaccatcccagccctggcgctctcagtggcaggcatccctgggttggatgaggccaacacatctccccgcctcagccagaccttcctccaactctcagatggtgacaagaagacactcacacggaagaaggtcaatcagttcttcaagacaatgctggccagcaaatcggctgaagaaggcaaacagatcccagactcgctgtccacggacctgtgagctgctgctgactagggctgcatgggagagccagggaggggagtttctggaagaggaaagccatgcgtggaacatcgaagcctcagagagtgggagactgtccccatcagttgtccttacttagaggagacagagaggccaatcaggtcccagagcttgagtgctaacaagcccagcatcccctggggctgtgatcatggtggatgaggaagcctcaacgtagattcctgaactcaaggtaccagcaagaatgccttctcccagtgtgctctccccaacatcctaggcacagctttcataacccagtttcttaggtgtaagaaactgtttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaataaaaaatgttctcttggttcgaa

SEQ ID NO: 311511 - DNA, 6284 bp, Homo sapiens
  misc_feature (3494)..(3494): n is a, c, g, or t
ggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaagagatcatggtccagctgctgcggacagtgaaccggacagtcatcaccatgggccgggatcacattctgattagtcactttgtggcatgtatgacagccatcttaaaccagatgggtgaccagcactactccttctacattgagaccttccagaccagctctgaacttgtggacttcttgatggagaccttcatcatgttcaaggacctcattggaaagaacgtgtaccctggagactggatggccatgagcatggttcaaaacagggtcttcctgagagctatcaacaagtttgcagaaaccatgaaccagaagttcctagaacacacgaactttgagttccagctgtggaacaactattttcatctggcagtggcttttatcacccaggattctctgcagctggagcagttctcacacgccaaatacaacaaaatcctgaataagtatggggacatgagacggctaattggcttctccatccgtgatatgtggtacaagcttggtcagaacaaaatctgcttcatcccaggcatggtaggacctatattagagatgacacttatccctgaggctgagctccggaaagccaccataccaatcttcttcgacatgatgctgtgtgaatatcaaagaagtggggatttcaaaaagtttgaaaacgaaatcatcctgaagctggaccacgaggtagaagggggccgaggcgacgagcagtacatgcagctnctggagtcaatcctgatggaatgtgctgcagagcacccaaccattgccaagtcggtggagaacttcgtgaacctggtcaaaggcctcctggagaagctgctggattaccggggtgtgatgacagatgagagcaaagacaaccgcatgagctgcactgtgaacctgctgaatttctacaaagataacaacagggaggagatgtacataaggtacctgtacaaactccgcgatcttcacctggactgtgacaattacacagaggctgcctacacgctccttctccacacctggcttctcaagtggtcggatgagcagtgtgcatcacaggtcatgcagacaggccagcagcacccccagacacaccggcagctgaaggagacgctctacgagaccatcataggctactttgacaaaggaaagatgtgggaagaggccataagtctgtgcaaggagctggcggaacagtacgagatggagatctttgactatgagctgctcagccagaacctgatccagcaggcaaaattctatgaaagcatcatgaaaatcctcaggcccaaaccagactactttgctgttggatactacggccagggattcccctccttcctgcggaacaaagtgttcatctaccgcgggaaggaatatgagcgaagagaagatttccagatgcagctgatgacccagttccccaatgcagagaagatgaacaccacctctgccccgggagatgatgtgaagaatgccccaggccagtatatccagtgcttcactgtccagcctgtcttggatgaacatcccaggttcaagaataagccagtgcctgaccagattataaacttctacaaatccaactacgtgcaaaggttccactactcccggcccgtgcgcagggggaccgtagacccagagaatgagtttgcttccatgtggattgagagaacctccttcgtgactgcatacaagctgccggggatcctgcgctggtttgaggtggtgcacatgtcgcagaccacaattagtcctctggagaatgccatagaaaccatgtccacggccaatgagaagatcctgatgatgataaaccagtaccagagtgatgagaccctccccatcaacccactctccatgctcctgaacgggattgtggaccctgctgtcatgggaggcttcgccaagtatgagaaggccttcttcactgaagagtatgtcagggaccaccctgaggaccaggacaagctgacccacctcaaggacctgattgcatggcagatccccttcttgggagctgggattaagatccatgagaaaagggtgtcagataacttgcgacccttccatgaccggatggaggaatgtttcaagaacctgaaaatgaaggtggagaaggagtacggtgtccgagagatgcctgactttgacgacaggagagtgggccgtcccaggtctatgctgcgctcatacagacagatgtccatcatctctctggcttccatgaattctgactgcagcacccccagcaagcctacctcagagagctttgacctggaattagcatcacccaagacgccgagagtggagcaggaggaaccgatctccccggggagcaccctgcctgaggtcaagctgcggaggtccaagaagaggacaaagagaagcagcgtagtttttgcggatgagaaagcagctgcagagtcggacctgaagcggctttccaggaagcatgagttcatgagtgacaccaacctctcggagcatgcggccatccccctcaaggcgtctgtcctctctcaaatgagctttgccagccagtccatgcctaccatcccagccctggcgctctcagtggcaggcatccctgggttggatgaggccaacacatctccccgcctcagccagaccttcctccaactctcagatggtgacaagaagacactcacacggaagaaggtcaatcagttcttcaagacaatgctggccagcaaatcggctgaagaaggcaaacagatcccagactcgctgtccacggacctgtgagctgctgctgactagggctgcatgggagagccagggaggggagtttctggaagaggaaagccatgcgtggaacatcgaagcctcagagagtgggagactgtccccatcagttgtccttacttagaggagacagagaggccaatcaggtcccagagcttgagtgctaacaagcccagcatcccctggggctgtgatcatggtggatgaggaagcctcaacgtagattcctgaactcaaggtaccagcaagaatgccttctcccagtgtgctctccccaacatcctaggcacagctttcataacccagtttcttaggtgtaagaaactgtttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaataaaaaatgttctcttggttcgaataagccttgttgcctgattctgttggctgactctcctgggcccaggactgggcaggaagctccctggaaggaaggcaggcccaggggctgcagtgatgtgaaggagcctggtgatgcccttgcccaatgccaaatttccccacctcatctatgagaagattcttcaagaatctccatgactcttgttccttaggtgccaaaccctgggctaccagcatgttaaaaaagttgc

SEQ ID NO: 311512 - DNA, 2875 bp, Homo sapiens
ggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcatttttcctaagtcatttatccacatcaaggaagtgacagttgagaaaagaagaaatactgagaacatcattcctgcagaaattcctctggcacaagaagtgacaacgacactttgggaatggggaagcatctggaaacaactctatgtggccagcaaaaaggagcgttttctccaggtgcagtccatgatgtacgatctgatggagtggaggtcccagcttctctcaggaaccttacccaaggatgagctgaaggaactgaagcagaaagtcacgtccaaaattgactatggcaacaaaatccttgagcttgatttgattgtcagagatgaagacggaaatatcttggaccctgataataccagtgtcatcagcttgttccatgcacatgaggaagcaactgataaaatcacagagcgtatcaaagaagaaatgtcaaaagaccagccagattatgcaatgtattcccggatctcctcatcccccacccatagcctctatgtgtttgtgagaaactttgtgtgcagaattggggaagatgctgagctcttcatgtctctctacgaccccaacaagcaaacggtcataagtgagaactacctagtgcgatggggcagccggggcttccctaaggagattgagatgctcaacaatctgaaggtggtcttcacggatcttggaaacaaagacctcaacagggataaaatttacttgatttgtcaaatagtccgggtcggcaagatggatcttaaggatactggtgcaaagaagtgcacgcagggactgaggaggccctttggggtggcagttatggatataacagacatcatcaaggggaaagcagagagtgatgaagaaaagcagcacttcattccttttcacccggttacagctgagaatgacttcctacacagcctgctgggcaaagtcatagcctccaagggggacagtggagggcaaggcctctgggtgaccatgaagatgctggtgggtgacatcattcagattcgcaaggactatccacacctggtggacaggaccaccgtggtggccaggaagctgggattcccagagatcatcatgccaggggatgtcaggaacgacatctacattactctcttacaaggtgactttgacaagtacaacaagaccacacagaggaatgtggaagtcatcatgtgtgtgtgcgcggaggatggcaaaacgctgcctaatgcaatttgcgtgggagcaggggacaagcccatgaatgagtatcgctccgttgtgtactatcaagtcaaacagccacgctggatggaaacagtcaaggtggctgtccctattgaagacatgcagaggatccatctgcgattcatgtttcgacatcggtcatctctggaatctaaagataaaggagaaaagaactttgccatgtcctatgtgaagctgatgaaagaagatgggactactctacacgatggattccatgacttagttgtcctcaagggggacagcaagaagatggaggatgccagcgcatacctgacccttccttcttatcgacaccatgtggaaaacaagggggccacgctgagcaggagctccagcagtgttggggggctttctgtcagctcccgggatgtgttctccatttccaccctggtgtgctccacaaagctcactcagaatgtgggcttgctgggtttgctgaagtggcgtatgaagcctcaactgctacaggagaatttagaaaagttgaagattgtggatggagaggaagtggtgaagtttctccaggatactctggatgccctcttcaacatcatgatggagcattctcaaagtgatgaatatgacatcctcgtctttgatgccttgatttacataataggactcattgcagaccggaaatttcagcatttcaacaccgttctggaggcttacatccaacagcatttcagtgcgaccttggcttacaagaaattgatgacagtgctgaagacttacttggatacctccagcagaggggagcaatgtgagccaatcctaagaacgctgaaggctttggaatatgtgttcaagttcattgttcggtcgaggacattattttcacagctttatgaaggcaaagaacagatggagtttgaagaatccatgagacggctctttgaatccatcaacaatctgatgaaaagtcaatacaaaactaccatccttttgcaggtggcggctttgaaatacatcccatctgtcctgcatgatgtagaaatggtctttgatgcgaagttactcagccaactcctgtatgagttctacacctgcatccctcctgtgaaactccagaagcagaaagtacagtctatgaatgagatagtccagagcaacctctttaaaaagcaagaatgccgggacattctgcttcctgtcatcaccaaagagctgaaggagctgctggagcagaaggatgacatgcaacaccaggtcctggagaggaagtactgcgttgaattgctcaacagcatcttggaagtccttagctaccaggatgcggccttcacctaccaccatatccaagagatcatggtccagctgctgcggacagtgaaccggacagtcatcaccatgggccgggatcacattctgattggagcttgctgcaactgcggattcccatcctccacccc

SEQ ID NO: 311513 - DNA, 414 bp, Homo sapiens
ccaattgcctggatactctaggggtactatgttctcaaaggggcacaagaccagtctaccttctaaattgccttgtcaggaaagcctgtgcaaaagtcactcttacggagcccagaacacagaccttgattttaaatgcaccacaagggactctgccaggcctgaagtttactgtaatgaacctccctggacagtgcagggtcagatcgggtgtcagcagccggggatggctaccaggagcctcagcctcttcctgtctttcagcttctacaaatccaactacgtgcaaaggttccactactcccggcccgtgcgcagggggaccgtagacccagagaatgagtttgctgtgagtatcttccctacccttgatcattccctggagccacctggaggaaccagagcatgcatcgg

SEQ ID NO: 311514 - DNA, 368 bp, Homo sapiens
gaactaggatgatagctagatctgtttgactacaaactcatgctcttcccacaattacactatgctatagcagagttttgcaagccctttttggctgtggaatgcactcagggagcttttccagaagcctaataggtgaaatagacagaagttgagctggattggttgaaatgcgagtgcaaagctgccagtctcgtgtgctcttgtcccctggccaccctcccaccagacataaccactgaaacacctcagggatccacttggactcagaaaaggccagtttgcaaaacactgtctacatatccctttaacagactgcataggatttacctttttatttgagacagagttttgctcttgttgcccat

SEQ ID NO: 311515 - DNA, 4359 bp, Homo sapiens
ctctggccgctgggaagacgtcatcgcttccgccctacttcctcctcctgttggcggcggtgagaatccaatatggagtaaatcggtggagtcgagagatggggctcggacggggcgccctgcaccgcctcccaggcgcacctcccccggccgccgaccgctccccggaaccgtgattggcccggccccccgggggcgaccccggactgagcccccccacccgcggccggcgctctcctcctcctcgcagcagtccctgccgctccgaggcgcgcttgtttttctcctgctctcccccaccgccgtccccttcccaaatctcgccccctctgcccgctcccgagcccccggagcctccgcccgcctctccccacggcgctgcggcgttcactccccgcgcagcctgcctttgcaccccttcccccaaaccctatcccgcgccctgcttccccttctgctgcggcgccctcttcatctctagccgccccccctccccaaatcaggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcccccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccagttgagaaacactaaggttatggtgaataaaaccatagggagcttcttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgcaactccaaacccagactcgccactttgggtgcacaggtggttaggtcagccaactggttctgcctgtcgccttgccacggaggaggcttctaattagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacatggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccagctgttttttgtttgtcacctctatttagttgttacctgtttctctcttctttcaccccttgtccttttccacccttttaagagttacgcatactgacgtcaatcatttgagagaaattattcagattttatttttgtatctgtggtaacaaaacattaaccaaaagattttctgtccagaagcctccccgaccccccaagctatttgctcacattaacaaattaaagtgcctgaagcataattcattctttacctgtatactaaaaaccctgttgtattgatttttttataataagcctttttacctctgtgtaaaaaatatatatacaagtgtatgatgtacattttagttcttaacttttttttatggtttctaatatgtatgaccaatgtagccattgctttaaaatgtaccgtgtaaatataaacacatcctatcaga

SEQ ID NO: 311516 - DNA, 3942 bp, Homo sapiens
ctctggccgctgggaagacgtcatcgcttccgccctacttcctcctcctgttggcggcggtgagaatccaatatggagtaaatcggtggagtcgagagatggggctcggacggggcgccctgcaccgcctcccaggcgcacctcccccggccgccgaccgctccccggaaccgtgattggcccggccccccgggggcgaccccggactgagcccccccacccgcggccggcgctctcctcctcctcgcagcagtccctgccgctccgaggcgcgcttgtttttctcctgctctcccccaccgccgtccccttcccaaatctcgccccctctgcccgctcccgagcccccggagcctccgcccgcctctccccacggcgctgcggcgttcactccccgcgcagcctgcctttgcaccccttcccccaaaccctatcccgcgccctgcttccccttctgctgcggcgccctcttcatctctagccgccccccctccccaaatcaggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcccccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccagttgagaaacactaaggttatggtgaataaaaccatagggagcttcttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgcaactccaaacccagactcgccactttgggtgcacaggtggttaggtcagccaactggttctgcctgtcgccttgccacggaggaggcttctaattagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacatggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccagctgcgtttgaggggaaaagaccctg

SEQ ID NO: 311517 - DNA, 4507 bp, Homo sapiens
ctctggccgctgggaagacgtcatcgcttccgccctacttcctcctcctgttggcggcggtgagaatccaatatggagtaaatcggtggagtcgagagatggggctcggacggggcgccctgcaccgcctcccaggcgcacctcccccggccgccgaccgctccccggaaccgtgattggcccggccccccgggggcgaccccggactgagcccccccacccgcggccggcgctctcctcctcctcgcagcagtccctgccgctccgaggcgcgcttgtttttctcctgctctcccccaccgccgtccccttcccaaatctcgccccctctgcccgctcccgagcccccggagcctccgcccgcctctccccacggcgctgcggcgttcactccccgcgcagcctgcctttgcaccccttcccccaaaccctatcccgcgccctgcttccccttctgctgcggcgccctcttcatctctagccgccccccctccccaaatcaggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcccccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccagttgagaaacactaaggttatggtgaataaaaccatagggagcttcttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgcaactccaaacccagactcgccactttgggtgcacaggtggttaggtcagccaactggttctgcctgtcgccttgccacggaggaggcttctaattagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacatggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccagctgttttttgtttgtcacctctatttagttgttacctgtttctctcttctttcaccccttgtccttttccacccttttaagagttacgctagcagatcttactccacgtatactttttggtttgtgaaggcatcggttaagggcacaaagacagccatggggacatttatgtaaatacgtctctaattgccacactgcagctgaacagtgtgtagtattttcccagtcagctttgccatactgacgtcaatcatttgagagaaattattcagattttatttttgtatctgtggtaacaaaacattaaccaaaagattttctgtccagaagcctccccgaccccccaagctatttgctcacattaacaaattaaagtgcctgaagcataattcattctttacctgtatactaaaaaccctgttgtattgatttttttataataagcctttttacctctgtgtaaaaaatatatatacaagtgtatgatgtacattttagttcttaacttttttttatggtttctaatatgtatgaccaatgtagccattgctttaaaatgtaccgtgtaaatataaacacatcctatcaga

SEQ ID NO: 311518 - DNA, 4090 bp, Homo sapiens
gactaaccctcggatgactcatccggtacaatgcagtatatttgtcaaggagactgaatcatatatgggggaaaccacttctcaggcagccagctggttctcaggtcagcaagagacgatccatttttatcggaagctttatagtagcaataatgctaatacccagcactcgggctccacaatgtagaggaaatggcatcgcctggcagtgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcccccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccagttgagaaacactaaggttatggtgaataaaaccatagggagcttcttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgcaactccaaacccagactcgccactttgggtgcacaggtggttaggtcagccaactggttctgcctgtcgccttgccacggaggaggcttctaattagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacatggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccagctgttttttgtttgtcacctctatttagttgttacctgtttctctcttctttcaccccttgtccttttccacccttttaagagttacgctagcagatcttactccacgtatactttttggtttgtgaaggcatcggttaagggcacaaagacagccatggggacatttatgtaaatacgtctctaattgccacactgcagctgaacagtgtgtagtattttcccagtcagctttgccatactgacgtcaatcatttgagagaaattattcagattttatttttgtatctgtggtaacaaaacattaaccaaaagattttctgtccagaagcctccccgaccccccaagctatttgctcacattaacaaattaaagtgcctgaagcataattcattctttacctgtatactaaaaaccctgttgtattgatttttttataataagcctttttacctctgtgtaaaaaatatatatacaagtgtatgatgtacattttagttcttaacttttttttatggtttctaatatgtatgaccaatgtagccattgctttaaaatgtaccgtgtaaatataaacacatcctatcaga

SEQ ID NO: 311519 - DNA, 4607 bp, Homo sapiens
ctctggccgctgggaagacgtcatcgcttccgccctacttcctcctcctgttggcggcggtgagaatccaatatggagtaaatcggtggagtcgagagatggggctcggacggggcgccctgcaccgcctcccaggcgcacctcccccggccgccgaccgctccccggaaccgtgattggcccggccccccgggggcgaccccggactgagcccccccacccgcggccggcgctctcctcctcctcgcagcagtccctgccgctccgaggcgcgcttgtttttctcctgctctcccccaccgccgtccccttcccaaatctcgccccctctgcccgctcccgagcccccggagcctccgcccgcctctccccacggcgctgcggcgttcactccccgcgcagcctgcctttgcaccccttcccccaaaccctatcccgcgccctgcttccccttctgctgcggcgccctcttcatctctagccgccccccctccccaaatcaggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcccccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccagttgagaaacactaaggttatggtgaataaaaccatagggagcttcttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgcaactccaaacccagactcgccactttgggtgcacaggtggttaggtcagccaactggttctgcctgtcgccttgccacggaggaggcttctaattagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacatggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccagctgttttttgtttgtcacctctatttagttgttacctgtttctctcttctttcaccccttgtccttttccacccttttaagagttacgctagcagatcttactccacgtatactttttggtttgtgaaggcatcggttaagggcacaaagacagccatggggacatttatgtaaatacgtctctaattgccacactgcagctgaacagtgtgtagtattttcccagtcagctttgccatactgacgtcaatcatttgagagaaattattcagattttatttttgtatctgtggtaacaaaacattaaccaaaagattttctgtccagaagcctccccgaccccccaagctatttgctcacattaacaaattaaagtgcctgaagcataattcattctttacctgtatactaaaaaccctgttgtattgatttttttataataagcctttttacctctgtgtaaaaaatatatatacaagtgtatgatgtacattttagttcttaacttttttttatggtttctaatatgtatgaccaatgtagccattgctttaaaatgtaccgtgtaaatataaacacatcctatcagaaaaaggacagaaaacccaagataaagggagaaaaaagggcagagaaaaagggggcgaaagagaaagaggaaaaaaaaaaaagggggggggcaaaaaacgg

SEQ ID NO: 311520 - DNA, 4440 bp, Homo sapiens
ctctggccgctgggaagacgtcatcgcttccgccctacttcctcctcctgttggcggcggtgagaatccaatatggagtaaatcggtggagtcgagagatggggctcggacggggcgccctgcaccgcctcccaggcgcacctcccccggccgccgaccgctccccggaaccgtgattggcccggccccccgggggcgaccccggactgagcccccccacccgcggccggcgctctcctcctcctcgcagcagtccctgccgctccgaggcgcgcttgtttttctcctgctctcccccaccgccgtccccttcccaaatctcgccccctctgcccgctcccgagcccccggagcctccgcccgcctctccccacggcgctgcggcgttcactccccgcgcagcctgcctttgcaccccttcccccaaaccctatcccgcgccctgcttccccttctgctgcggcgccctcttcatctctagccgccccccctccccaaatcaggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcccccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccagttgagaaacactaaggttatggtgaataaaaccatagggagcttcttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgtcgccttgccacggaggaggcttctaattagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacatggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccagctgttttttgtttgtcacctctatttagttgttacctgtttctctcttctttcaccccttgtccttttccacccttttaagagttacgctagcagatcttactccacgtatactttttggtttgtgaaggcatcggttaagggcacaaagacagccatggggacatttatgtaaatacgtctctaattgccacactgcagctgaacagtgtgtagtattttcccagtcagctttgccatactgacgtcaatcatttgagagaaattattcagattttatttttgtatctgtggtaacaaaacattaaccaaaagattttctgtccagaagcctccccgaccccccaagctatttgctcacattaacaaattaaagtgcctgaagcataattcattctttacctgtatactaaaaaccctgttgtattgatttttttataataagcctttttacctctgtgtaaaaaatatatatacaagtgtatgatgtacattttagttcttaacttttttttatggtttctaatatgtatgaccaatgtagccattgctttaaaatgtaccgtgtaaatataaacacatcctatcaga

SEQ ID NO: 311521 - DNA, 4487 bp, Homo sapiens
ctctggccgctgggaagacgtcatcgcttccgccctacttcctcctcctgttggcggcggtgagaatccaatatggagtaaatcggtggagtcgagagatggggctcggacggggcgccctgcaccgcctcccaggcgcacctcccccggccgccgaccgctccccggaaccgtgattggcccggccccccgggggcgaccccggactgagcccccccacccgcggccggcgctctcctcctcctcgcagcagtccctgccgctccgaggcgcgcttgtttttctcctgctctcccccaccgccgtccccttcccaaatctcgccccctctgcccgctcccgagcccccggagcctccgcccgcctctccccacggcgctgcggcgttcactccccgcgcagcctgcctttgcaccccttcccccaaaccctatcccgcgccctgcttccccttctgctgcggcgccctcttcatctctagccgccccccctccccaaatcaggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttcgccaagggcgaggtccccaagcatgactacaactacccctacgtggactcctcagactttggcctaggcgaggaccccaaaggccgcgggggcagcgtgatcaagacgcagccctcccggggcaagtcgcggcggcggaaggaggacggagagcgctcgcggtgcgtgtactgcagggacatgttcaaccacgaggagaaccgccggggccactgccaggacgcccccgactccgtgagaacttgcatccgccgggtgagctgcatgtggtgcgcggacagcatgctctatcactgtatgtcggaccccgagggagactatacagacccttgctcgtgcgatactagcgacgagaagttttgcctccggtggatggctcttattgccttgtctttcctggccccctgtatgtgctgttacctgccccttcgggcctgctaccactgcggagtgatgtgcaggtgctgtggcgggaagcacaaagcggccgcgtgactcagtttccctcccttctccctccatccgcagccacaggggaactcgtctcttacatactctcatcttctcccccgctcccttccactccaaggagcgaggagggcaagcggcctcccagctccctggtacctcgaggcaccattccagccagggacgctgccgggtagactctccactccccctgccgcccacactgcagcagccacatccatacacacacgctcgcacagtgttctgaggaaggaaccttcgccacagactcctgtactattaacaatctgtaaccaagctaactgtctcatccatgtgttgatttcctgtttcctcctcccccgcctcttccagttcaaaggagtctgcaattggaactgctgattttcggtgggttttgtagttgatttttccaagagcgtcgaagactctctttctcttggttcaccttgcctgtcgctagcaagcatctggttcagcggaaatgggatgtgagaatgatgaaacccgacagaagtatctcagcctgcagtcagttattatgtataggaggtgagctagttaacaaacttgtaccacaaaacaatatcgctttaacttttctaaagccaaatttcccatgtaagctgcagtttctatctttagcccatcatcattttctgcccccccaaaatctgttgaaatgattcactgatgcaaaacattcacccgtaatagactgagaattgagccttaacttcagattaacttgtgagaatcaggaaaattccttcaactgcattgcatcctcttggaccagggctagaatggggatttcaggtttctatgagcctccccattacccctaaagtagaacattttttaaattgtgttgccaccacttctaaaaatttagcaatattagaataggatactagtgaagtaagaaattttgcttgttgttttgcaaaccaaatagtttcctcaaacacaaatcagtgttcccacgaacaagttccagttgagaaacactaaggttatggtgaataaaaccatagggagcttcttccccccaacccctggctattttatattaatggggagaggggatttttaaatgtcataaatttgaagagtggtgggttgcattttcttcatgggtttatgttttcgtttcattttggactcaatttcacatcaccaaattcctcatttatacttggggaaaaaacaaggccatatgtaaaaacccttccaatgcctaagtgtctttctcctgcaactccaaacccagactcgccactttgggtgcacaggtggttaggtcagccaactggttctgcctgtcgccttgccacggaggaggcttctaattagctggaaaagagtatttttctaatacgttgcaaggattagccaaatcttcttattgaagaaagaagaaaagtgaagagtggttacctatacctagcatagtacaatcagaacctcgtggagaccaccggggacaggcttgcggacgccggctgttcttcccgccacgatctttctgtggtagcggccagcagaagacatggcctgctccccactccctttccccactccttctttattgcacacaggacaccagtcttcaaggaaagggacttttttccagtctgccaatcatattgggaaagtgctagctgtgctcaccttcatggggctgtttccagctcgtccacaagctcatcgattttctttagtagattaccggtgtaaatacccagtgtgcttatgagtcagttagtagacgtcttcattcattggagtaactggtttaggctttccagtttggaaaaggagcagagagctgtccatctggattgatggaagaaaagagaacctcatccatgcctggagaacatctagaaaaccttcagccagcctccagtgctgtcgagagaccaccttcccccgacccggaggcacttccttggggtctttctctagggtctcttctctacaaagcacaacactaatgttcgtttccttagacctcagttcaagtgcccctatttatttcaataagaacgcacatatcccagctgttttttgtttgtcacctctatttagttgttacctgtttctctcttctttcaccccttgtccttttccacccttttaagagttacgctagcagatcttactccacgtatactttttggtttgtgaaggcatcggttaagggcacaaagacagccatggggacatttatgtaaatacgtctctaattgccacactgcagctgaacagtgtgtagtattttcccagtcagctttgccatactgacgtcaatcatttgagagaaattattcagattttatttttgtatctgtggtaacaaaacattaaccaaaagattttctgtccagaagcctccccgaccccccaagctatttgctcacattaacaaattaaagtgcctgaagcataattcattctttacctgtatactaaaaaccctgttgtattgatttttttataataagcctttttactacaagtgtatgatgtacattttagttcttaacttttttttatggtttctaatatgtatgaccaatgtagccattgctttaaaatgtaccgtgtaaatataaacacatcctatcaga

SEQ ID NO: 311522 - DNA, 1540 bp, Homo sapiens
ctctggccgctgggaagacgtcatcgcttccgccctacttcctcctcctgttggcggcggtgagaatccaatatggagtaaatcggtggagtcgagagatggggctcggacggggcgccctgcaccgcctcccaggcgcacctcccccggccgccgaccgctccccggaaccgtgattggcccggccccccgggggcgaccccggactgagcccccccacccgcggccggcgctctcctcctcctcgcagcagtccctgccgctccgaggcgcgcttgtttttctcctgctctcccccaccgccgtccccttcccaaatctcgccccctctgcccgctcccgagcccccggagcctccgcccgcctctccccacggcgctgcggcgttcactccccgcgcagcctgcctttgcaccccttcccccaaaccctatcccgcgccctgcttccccttctgctgcggcgccctcttcatctctagccgccccccctccccaaatcaggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaaggttcaacaacgtcatcttccaccatccataatgaagctgagcttggcgatgatgacgtttttacaacagctacagacagttcttctaattcctctcagaagagagagcaacctactcggacaatctcctctcccacatcctgtgagcaccggaggatttataccctgggccacctccacgactcataccccacagaccactatcacctcgatcagccgatgccaaggccctaccgccaggtgagcttcccggacgacgacgaggagatcgtgcgcatcaacccccgggagaagatctggatgacggggtacgaggattaccggcacgcacccgtcaggggcaagtacccggacccctcggaggacgcggactcctcctacgtgcgcttccgcagggggagtcccaagctgactaaaataccctatgtgatctcgatttggctagggaagaaccaaagcggggggcagtatcaaagcactccgggcagtgcggggcaagagaagcaccccggggtttgcggcttcaccccaggaagcggctgcgagcgccctaaaatccggaaaatgg

SEQ ID NO: 311523 - DNA, 1221 bp, Homo sapiens
ctctggccgctgggaagacgtcatcgcttccgccctacttcctcctcctgttggcggcggtgagaatccaatatggagtaaatcggtggagtcgagagatggggctcggacggggcgccctgcaccgcctcccaggcgcacctcccccggccgccgaccgctccccggaaccgtgattggcccggccccccgggggcgaccccggactgagcccccccacccgcggccggcgctctcctcctcctcgcagcagtccctgccgctccgaggcgcgcttgtttttctcctgctctcccccaccgccgtccccttcccaaatctcgccccctctgcccgctcccgagcccccggagcctccgcccgcctctccccacggcgctgcggcgttcactccccgcgcagcctgcctttgcaccccttcccccaaaccctatcccgcgccctgcttccccttctgctgcggcgccctcttcatctctagccgccccccctccccaaatcaggcgatctccggagatgtgaagaaggggggcgagcggacaggaagatgaagggagcaaagctgcccgccgcgggacaggcgtctaggtgaacaagaaaatgaccgaagaaacacacccagacgatgacagctatattgtgcgtgtcaaggctgtggttatgaccagagatgactccagcgggggatggttcccacaggaaggaggcgggatcagtcgcgtcggggtctgtaaggtcatgcaccccgaaggcaatggacgaagcggctttctcatccatggtgaacgacagaaagacaaactggtggtattggaatgctatgtaagaaaggacttggtctacaccaaagccaatccaacgtttcatcactggaaggtcgataataggaagtttggacttactttccaaagccctgctgatgcccgagcctttgacaggggagtaaggaaagcaatcgaagaccttatagaagaagtagagaatggattctggcgggcccagaaggctcctggcctacccactgtcctcctgtaatcagaggcccagggtgtacagctgccactgaaaaggaaagggatctgtgacctctggagccctggttcggtttaggccttggtctatggcagcgagtgcagaagtttgagagattaattgggaacaacagcaggcaaagttaatttagggagcatcctggcaagaatcaattaaagaagagtaaat

SEQ ID NO: 311524 - DNA, 1855 bp, Homo sapiens
gctcatggcaacctctgcctcccaggttcaagcgattgtcctgcctcagtctcctgagtagctgggactacaggtgtgcaccaacatgcccagctaattttttatatttttagtagagacggggtttcaccatgttggccaggatggtctcgatctcttgaccttgtgttccacccgtcttggcctcccaaagcgctggaattacaggcatgagccaccgcgcctggcctgtatatgtgatttctaaaaaatagatgcatgcatatgttaacattgaatagtcaatcactagatgaagatgctctctaccatggtttagattgcaagtgtactttataccattgtttcaacttcaacctttatttttgtatatattttttcaactacttaaactgttcatgaataggcgtactttctgtatttaaaaatggcccctcaagcaccgttaatttacattccagttatttacatgataattcatgacattctgaaacttgcctgtatattatctgaaaaatggatttcttgaggaaaagatctgtttattgtatgtaaggaaaaattttacctgaaaacaaacaaacaaaccctaaaactcagcaccactaccatttccagaagcttttttagcaagtgaatattttttacataatggataataaatggtatttattcatcatgattttctaagtaatgcttatcagccccttcagtggtgttattctaacaaaatgaatacattacaaattattaagttagcttttcagagttttaatatagaagttactagcactgacacactgattttgaaatgtttcaaaatgagtagatacgattagatcctttaccttttaatatctagtttttccaaaaatgatagtaatatcttttgaagaactatgctttttcaaaagcaaaatcaactctgtataatagcacattctctactttttaaagatcagaaatgctagaattcttgacttttgtgtatgggtagtaaatctagctcactgaaaatcagagtgaaacgcctttacatttgtgcggatagagaagttaactctccctcatatgtcactgtgctaccataatccctacattttctgtctgttctagtctaagaatattgttatagatggaagttaggaccattagcccacagatgcgtgtattctctcagacataccggtgtagatgccatatttctgatgtcttcttaatgtctgtgaaagcaactggcatctacaataaatcacacttagaactggttagaggactccctcacttttgttgtccatgtggttcccttccgtggaccagccgtaataaagagccaaggtagtgatggtggccacgtgcctcgttgctatttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaaatgaaccatcatgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtc

SEQ ID NO: 311525 - DNA, 1553 bp, Homo sapiens
ctcgggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatatagaaaagctggaagattatgactagatatggaaatattttttctgaatttttttttatatttcctccgacttacctctttttgaaaagagagtttttattaaatgaaccatcatgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtc

SEQ ID NO: 311526 - DNA, 1576 bp, Homo sapiens
ctcgggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatataggtaggtatgcatcttgagaaagctactatgtgcccctgacattaacgtactgttaaccaagacacagcaatcatcagtgttttgatggtaacaaactttgatggtaaagttgataaaaggcaactttcagaagaaaataatgtgctttagaaaaaaaattcaaatttatagtagtatatttacatttttgttgttgttgttgttctgagatggagtctcactctgtcgcccaggctagactgcagtggtgcaatctcagctcactgcaacctcccccctacccctgagttcaagcgattctcctgcctcagcctgctga

SEQ ID NO: 311527 - DNA, 766 bp, Homo sapiens
ctcgggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaagatcaaagttataagcttatcttagttgagtagatgttgcctgatttttgaatgtgagctagaa

SEQ ID NO: 311528 - DNA, 472 bp, Homo sapiens
tcttgaagttaagcatcctgactctgtctgcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatatagaaaagctggaagattatgactagatatggaaatattttttctgaatttttttttatatttcctccgacttacctctttttgaaaagagagtttttattaaatgaaccatcatgatattggctgaaaagttctacattctattattgtattgtaacacacatgtattgatgattttcattaagagtttcagattaactttgaaaatttaaaggctaccttattgtacgattaaagtgtattatacacacttgtggagaggttaatagaaatcactatttttttttcaagaa

SEQ ID NO: 311529 - DNA, 300 bp, Homo sapiens
attgtctacacgcatttagtcacttggttatattccttcttcctgttttatacttttacaaaaaattgtttaatatgggtaaattttgccccattaacaagcttctccagggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatgtccctggcaagaacccattctactttctatctctatgaatttg

SEQ ID NO: 311530 - DNA, 2083 bp, Homo sapiens
  misc_feature (1617)..(1618): n is a, c, g, or t
  misc_feature (1624)..(1624): n is a, c, g, or t
  misc_feature (1627)..(1627): n is a, c, g, or t
  misc_feature (1633)..(1633): n is a, c, g, or t
ctcgggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatatagaaaagctggaagattatgactagatatggaaatattttttctgaatttttttttatatttcctccgacttacctctttttgaaaagagagtttttattaaatgaaccatcatgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtcaaaaaaaaaaaaaaaaaaaaaaaaaaaaaaaaaaaaaaaaaaaaaaaaaaaaaaaaaaaaaaannaaaaanaanaaaaanaaaaaaacatgcggcccaatttagccctacctccctctattctgcgcccacagttagcccgcgcgccccatttattgacgcttcctttttacaaatggcccctattgggggagcccctttccattcccaccttcgtcgttttaacaccaaacggcccttttaaaccccttggggaccccaaattaaaccccctccgaccccccctcctttagcggtcggccttaatgaggttgccccccccaagcggccttctcacgttgggccccccctaattttctgtgaaaacatgcaacccttaatccattggacaatttgcggttaattcttttctttacccccaattgttttcaccaataggcggatctgggaatcacccttttaccaccagaccccttctcccggatctgggctctgcggcgtccacctgtttgaacctcttatacgggcaag

SEQ ID NO: 311531 - DNA, 2385 bp, Homo sapiens
  misc_feature (1919)..(1920): n is a, c, g, or t
  misc_feature (1926)..(1926): n is a, c, g, or t
  misc_feature (1929)..(1929): n is a, c, g, or t
  misc_feature (1935)..(1935): n is a, c, g, or t
gctcatggcaacctctgcctcccaggttcaagcgattgtcctgcctcagtctcctgagtagctgggactacaggtgtgcaccaacatgcccagctaattttttatatttttagtagagacggggtttcaccatgttggccaggatggtctcgatctcttgaccttgtgttccacccgtcttggcctcccaaagcgctggaattacaggcatgagccaccgcgcctggcctgtatatgtgatttctaaaaaatagatgcatgcatatgttaacattgaatagtcaatcactagatgaagatgctctctaccatggtttagattgcaagtgtactttataccattgtttcaacttcaacctttatttttgtatatattttttcaactacttaaactgttcatgaataggcgtactttctgtatttaaaaatggcccctcaagcaccgttaatttacattccagttatttacatgataattcatgacattctgaaacttgcctgtatattatctgaaaaatggatttcttgaggaaaagatctgtttattgtatgtaaggaaaaattttacctgaaaacaaacaaacaaaccctaaaactcagcaccactaccatttccagaagcttttttagcaagtgaatattttttacataatggataataaatggtatttattcatcatgattttctaagtaatgcttatcagccccttcagtggtgttattctaacaaaatgaatacattacaaattattaagttagcttttcagagttttaatatagaagttactagcactgacacactgattttgaaatgtttcaaaatgagtagatacgattagatcctttaccttttaatatctagtttttccaaaaatgatagtaatatcttttgaagaactatgctttttcaaaagcaaaatcaactctgtataatagcacattctctactttttaaagatcagaaatgctagaattcttgacttttgtgtatgggtagtaaatctagctcactgaaaatcagagtgaaacgcctttacatttgtgcggatagagaagttaactctccctcatatgtcactgtgctaccataatccctacattttctgtctgttctagtctaagaatattgttatagatggaagttaggaccattagcccacagatgcgtgtattctctcagacataccggtgtagatgccatatttctgatgtcttcttaatgtctgtgaaagcaactggcatctacaataaatcacacttagaactggttagaggactccctcacttttgttgtccatgtggttcccttccgtggaccagccgtaataaagagccaaggtagtgatggtggccacgtgcctcgttgctatttttaaagtaatattcagatgtggttttaaatttagattatgtattccttttgaaacataagaaaaacatttaaacctatgctgaaaatacgataaaagaaaaacaactccaatatgctaaaagttaaatatggtatttaagaaaatagtcatgtatgcaattgagaaagtctataatttattttacagaaaagctggaagattatgactagatatggaaatattttttctgaatttttttttatatttcctccgacttacctctttttgaaaagagagtttttattaaatgaaccatcatgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtcaaaaaaaaaaaaaaaaaaaaaaaaaaaaaaaaaaaaaaaaaaaaaaaaaaaaaaaaaaaaaaannaaaaanaanaaaaanaaaaaaacatgcggcccaatttagccctacctccctctattctgcgcccacagttagcccgcgcgccccatttattgacgcttcctttttacaaatggcccctattgggggagcccctttccattcccaccttcgtcgttttaacaccaaacggcccttttaaaccccttggggaccccaaattaaaccccctccgaccccccctcctttagcggtcggccttaatgaggttgccccccccaagcggccttctcacgttgggccccccctaattttctgtgaaaacatgcaacccttaatccattggacaatttgcggttaattcttttctttacccccaattgttttcaccaataggcggatctgggaatcacccttttaccaccagaccccttctcccggatctgggctctgcggcgtccacctgtttgaacctcttatacgggcaag

SEQ ID NO: 311532 - DNA, 1587 bp, Homo sapiens
ctcgggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatatagaaaagctggaagattatgactagatatggaaatattttttctgaatttttttttatatttcctccgacttacctctttttgaaaagagagtttttattaaatgaaccatcatgatattggctgaaaagttctacagagaaataaatatcataaagaaaaaacagtcacaagttctggaaatgaaagacacactaagagaaataaaaaatacactggaaagtttcaacaatagactataacaagtagaagaaagaacttcagagctcaaagacaaggcttacaaattaaccgaaagacaaagaaaaatgaacaaagccttggggtaccgag

SEQ ID NO: 311533 - DNA, 1468 bp, Homo sapiens
ctcgggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcagcaactggaagacactggtgactgatgaaaacagaagggtggccaggaagccagacaacatttagactggctcatagacccgaagagacttcttgcccttgttcccagatgacccttcggcactcggaacttaggggtcaactgttcgggacatgacgttacagaccttttggcaaagaactgcttgggaacggcactcgcctggtgcgtcgcacacttgttcacgcacccactgaccaattccgcaccgcgctttggcgcgttggaaccaacctactgcgcattcggcatgtgtacccccatccaccaatcctccctcttgcgcaatactacgtcaccctcaattccccccactttcctg

SEQ ID NO: 311534 - DNA, 1858 bp, Homo sapiens
  misc_feature (1617)..(1618): n is a, c, g, or t
  misc_feature (1624)..(1624): n is a, c, g, or t
  misc_feature (1627)..(1627): n is a, c, g, or t
  misc_feature (1633)..(1633): n is a, c, g, or t
ctcgggtgctccgccctccccgcaggcggcgtgcggctgcatagcctgagaatcccggtggtgagcggggatggcggttgtagcggcggctgccggctggctactcaggctcagggcggcaggggctgaggggcactggcgtcggcttcctggcgcggggctggcgcggggctttttgcaccccgccgcgactgtcgaggatgcggcccagaggcggcaggtggctcattttactttccagccagatccggagccccgggagtacgggcaaactcagaaaatgaatcttttccagtctgtaacaagtgccttggataactcattggccaaagatcctactgcagtaatatttggtgaagatgttgcctttggtggagtctttagatgcactgttggcttgcgagacaaatatggaaaagatagagtttttaataccccattgtgtgaacaaggaattgttggatttggaatcggaattgcggtcactggagctactgccattgcggaaattcagtttgcagattatattttccctgcatttgatcagattgttaatgaagctgccaagtatcgctatcgctctggggatctttttaactgtggaagcctcactatccggtccccttggggctgtgttggtcatggggctctctatcattctcagagtcctgaagcattttttgcccattgcccaggaatcaaggtggttatacccagaagccctttccaggccaaaggacttcttttgtcatgcatagaggataaaaatccttgtatattttttgaacctaaaatactttacagggcagcagcggaagaagtccctatagaaccatacaacatcccactgtcccaggccgaagtcatacaggaagggagtgatgttactctagttgcctggggcactcaggttcatgtgatccgagaggtagcttccatggcaaaagaaaagcttggagtgtcttgtgaagtcattgatctgaggactataataccttgggatgtggacacaatttgtaagtctgtgatcaaaacagggcgactgctaatcagtcacgaggctcccttgacaggcggctttgcatcggaaatcagctctacagttcaggaggaatgtttcttgaacctagaggctcctatatcaagagtatgtggttatgacacaccatttcctcacatttttgaaccattctacatcccagacaaatggaagtgttatgatgcccttcgaaaaatgatcaactattgaccatatagaaaagctggaagattatgactagatatggaaatattttttctgaatttttttttatatttcctccgacttacctctttttgaaaagagagtttttattaaatgaaccatcatgatattggctgaaaagttctacattctattattgtattgtaacacacatgtattgatgattttcattaagagtttcagattaactttgaaaaatattccacatggtaatcttataaattctgtttaattacatctgtaaatattatgtgtgtgatagtattcaataaagtaaaatcaaattgtcaaaaaaaaaaaaaaaaaaaaaaaaaaaaaaaaaaaaaaaaaaaaaaaaaaaaaaaaaaaaaaannaaaaanaanaaaaanaaaaaaaaatttagaaaaaaaaaaattaaataaatgagacaataatataaggctaattggacaaataaagcccaataataagccgttttacatttcattggccgaccttttaaaacctcgagactgtaaaaaccgtggcgtgacccaatttaatcgctttgtatcctattgccgtttggccagctaacgtattatccaatagttccaaaaccgttcgcctttcaa

SEQ ID NO: 311535 - DNA, 1785 bp, Homo sapiens
aaatctttaatcttggtccttaaaagaaactaaaataaaatcgtaaagtagttctgataagtccttgccataaattattgcttttgtaaacgcacataaaggactctgaactgttgctactcataacatttctgacgccaaatgtgtggggttttgccataccaacaaccagttctctaactctccagacaccaactgggggccttacaattcagtgcagttctgacactcaccacctggagttagcacagactccacagggatgagggttcagtcccacgagtctgcccttgctgcagatgcgagtagcaggtatggggtgcccacacttctgtctgacttgcctgaaaggttgagagtttgttgccaggccccttgctttcaggtctgataacttgctaggttattaaacctgaaacttgataacttctgtagatgttgaaattagaacggcctcactcacctgggctcacaaaattccagaaagtagttgacgtcctattactggtttaccgtgaaggctctatgtccagagtggacaggacaagtggaagagtggcacagggcgaggtgtggggggtggcgtggagctccttttcaggagtctctaagaaggtgggactccagcggcaatgccttgtccatgtgctaagccagccgagggcgcacgaagtgctgtgtggtgtccaagctgacttgggagggaccagtttggggccagccccccagcctcacttgtcatgtcccacctctgctggcatctgtgggcttaaagtgccttcactcccatccttttcaactatttcttgattaaaaaaaaaaaaacaaaaaactgttgaatagtaggagactctctctctcattggtatttgtgggaataaatattaaataaacactttctaataggtgttaccaggacgcctaaggaaattatctcacagagttttcaacactgtgaaaagagaagctgactgccagggagagatccctttttcctagtccttgtgaacatgtgctggacagccaggagtggcactgtggcaagaaacacccgttctctggcattagtaagagggatatagccaagggtatctgtataccagtgttaggcccatacatccataaaacattgatgtgagagctttagggcacagctgaccctaagcctaacgtgatcattaatgtcatgaaaattggagaattggtcaggcgcggtggctcacacctgtaatcccagcacgttgggaggccgaggtggatagatcacttgaggtcaggagttcaagaccaacctgggcaacatggtgaaaccccgtctcaaaagaaaaaaaagaaaagaaaattggagaatttataacgtctgatgtgacctgttctttaggtgttgaaattagaacggcctcactcacctgggacattcttcagctcatgccctgtacctggcttacagttgctcagtgaaatgctttcttgattgtagcatggtgggatttttataaatccaaatgacttagaggtaggtgtcacatttttagcagctaaaatcatactaatcgtaaagctcagattcctgtaagtagggcgctgagcacaggctgcatcctggatatatgaatagatgaaccagatcgtgtacatgtgggacacgttctttgtcctttgggactttcttttgcttggatgttggtagtaaccatgtaagttcgggcagctttctagaaactttccttgttgtgcaacattatgcaataaatgcactgcttaggatcatctgcgcagggtttg

SEQ ID NO: 311536 - DNA, 3682 bp, Homo sapiens
tgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcattttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgattgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgca

SEQ ID NO: 311537 - DNA, 3621 bp, Homo sapiens
gtccctgatagaacacacgcaggagcagagtcccctccccctccaggctgccctctcaactttcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttggcttgtgtgatggtgcagtcattttactggaccaacccacccaccttgactataccaaggcatcatctatccacagttctagcctaacttcatgctgatttctctgcctcttgatttttctctgtgtgttccaaataatcttaagctgagttgtggcattttccatgcaacctccttctgccagcagctcacactgcttgaagtcatatgaaccactgaggcacatcatggaattgatgtgagcattaagacgttctcccacacagcccttccctgaggcagcaggagctggtgtgtactggagacactgttgaacttgatcaagacccagaccaccccaggtctccttcgtgggatgtcatgacgtttgacatacctttggaacgagcctcctccttggaagatggaagaccgtgttcgtggccgacctggcctctcctggcctgtttcttaagatgcggagtcacatttcaatggtacgaaaagtggcttcgtaaaatagaagagcagtcactgtggaactaccaaatggcgagatgctcggtgcacattggggtgctttgggataaaagatttatgagccaactattctctggcaccagattctaggccagtttgttccactgaagcttttcccacagcagtccacctctgcaggctggcagccgaatggcttgccagtggctctgtggcaagatcacactgagatcgatgggtgagaaggctaggatgcttgtctagtgttcttagctgtcacgttggctccttccagggtggccagacggtgttggccactcccttctaaaacacaggcgccctcctggtgacagtgacccgccgtggtatgccttggcccattccagcagtcccagttatgcatttcaagtttggggtttgttcttttcgttaatgttcctctgtgttgtcagctgtcttcatttcctgggctaagcagcattgggagatgtggaccagagatccactccttaagaaccagtggcgaaagacactttctttcttcactctgaagtagctggtggtacaaatgagaacttcaagagaggatgttatttagactgaacctctgttgccagagatgctgaagatacagaccttggacaggtcagagggtttcatttttggccttcatcttagatgactggttgcgtcatttggagaagtgagtgctccttgatggtggaatgaccgggtggtgggtacagaaccattgtcacagggatcctggcacagagaagagttacgagcagcagggtgcagggcttggaaggaatgtgggcaaggttttgaacttgattgttcttgaagctatcagaccacatcgaggctcagcagtcatccgtgggcatttggtttcaacaaagaaacctaacatcctactctggaaactgatctcggagttaaggcgaattgttcaagaacacaaactacatcgcactcgtcagttgtcagttctggggcatgactttagcgttttgtttctgcgagaacataacgatcactcatttttatgtcccacgtgtgtgtgtccgcatctttctggtcaacattgttttaactagtcactcattagcgttttcaatagggctcttaagtccagtagattacgggtagtcagttgacgaagatctggtttacaagaactaattaaatgtttcattgcatttttgtaagaacagaataattttataaaatgtttgtagtttataattgccgaaaataatttaaagacactttttttttctctgtgtgtgcaaatgtgtgtttgtgatccattttttttttttttttaggacacctgtttactagctagctttacaatatgccaaaaaaggatttctccctgaccccatccgtggttcaccctcttttccccccatgctttttgccctagtttataacaaaggaatgatgatgatttaaaaagtagttctgtatcttcagtatcttggtcttccagaaccctctggttgggaaggggatcattttttactggtcatttccctttggagtgtagctactttaacagatggaaagaacctcattggccatggaaacagccgaggtgttggagcccagcagtgcatggcaccgttcggcatctggcttgattggtctggctgccgtcattgtcagcacagtgccatggacatgggaagacttgactgcacagccaatggttttcatgatgattacagcatacacagtgatcacataaacgatgacagctatggggcacacaggccatttgcttacatgcctcgtatcatgattgattactgctttgttagaacacagaagagaccctattttatttaaggcagaaccccgaagatacgtatttccaatacagaaaagaatttttaataaaaactataacatacacaaaaattggttttaaagttgactccacttcctctaactccagtggattgttggccatgtctccccaactccacaatatctctatcatgggaaacacctggggtttttgcgctacataggagaaagatctggaaactatttgggttttgttttcaacttttcatttggatgtttggcgttgcacacacacatccaccggtggaagagacgcccggtgaaaacacctgtctgctttctaagccagtgaggttgaggtgagaggtttgccagagtttgtctacctctgggtatccctttgtctgggataaaaaaaatcaaaccagaaggcgggatggaatggatgcaccgcaaataatgcattttctgagttttcttgttaaaaaaaaatttttttaagtaagaaaaaaaaaggtaataacatggccaatttgttacataaaatgactttctgtgtataaattattcctaaaaaatcctgtttatataaaaaatcagtagatgaaaaaaatttcaaaatgtttttgtatattctgttgtaagaatttattcctgttattgcgatatactctggattctttacataatggaaaaaagaaactgtctattttgaatggctgaagctaaggcaacgttagtttctcttactctgcttttttctagtaaagtactacatggtttaagttaaataaaataattctgtatgca

SEQ ID NO: 311538 - DNA, 574 bp, Homo sapiens
tgtaccaaaccttccggctggaaagcccagtggccggcgccgaggctcgtggcgtcacgccccccccgccagggctgtacctccgtctccctggtcctgctgctcacaggacagacggctcgctcccctcttccagcagctgctcttacaggcactgatgatttcgctgggaagtgtggcgggcagctttgcctaagcgtggatggctcctcggcaattccagcctaagtgaaggcgctcaggagcctcctgctggaacgcgacccatctctcccaggaccccggggatcttaaggtcattgagaaatactgttggatcagggttttgttcttccacactgtaggtgaccccttggaataacggcctctcctctcgtgcacatacctaccggtttccacaactggatttctacagatcattcagctggttataagggttttgtttaaactgtccgagttactgatgtcattttgtttttgttttatgtaggtagcttttaagtagaaaacactaacagtgtagtgcccatcatagcaaatgcttcagaaacacctcaataaaagagaaaacttg

SEQ ID NO: 311539 - DNA, 7300 bp, Homo sapiens
  misc_feature (5095)..(5095): n is a, c, g, or t
acagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagatttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaaccttgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgnttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaa

SEQ ID NO: 311540 - DNA, 7444 bp, Homo sapiens
  misc_feature (5095)..(5095): n is a, c, g, or t
acagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagatttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaaccttgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgnttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttcttttggataatgttggtgtaatgtgtcattccttaagaattctactgttatataccatttttattaaggtcattgcaataaataaacatgaaaacatacccagaaaaa

SEQ ID NO: 311541 - DNA, 7315 bp, Homo sapiens
  misc_feature (4966)..(4966): n is a, c, g, or t
gcatacctgcctgggtgtccaaatgtaactagatgctttcacaaaccccacccacaaagcagcacatgtttttaagacttcagttttctattcacatcggcctcataatacccaccctgacctgctgtaaaagacctggaacaaacaaaaatgattacacctacagtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagatttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaaccttgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgnttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttcttttggataatgttggtgtaatgtgtcattccttaagaattctactgttatataccatttttattaaggtcattgcaataaataaacatgaaaacatacccagaaaaa

SEQ ID NO: 311542 - DNA, 7493 bp, Homo sapiens
  misc_feature (5144)..(5144): n is a, c, g, or t
acagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagatttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaaccttgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgnttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttcttttggataatgttggtgtaatgtgtcattccttaagaattctactgttatataccatttttattaaggtcattgcaataaataaacatgaaaacatacccagaaaaa

SEQ ID NO: 311543 - DNA, 6860 bp, Homo sapiens
  misc_feature (4511)..(4511): n is a, c, g, or t
ggtcgacacagttccatggaataactaagaattcatgtcctgtggaaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagatttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaaccttgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgnttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttcttttggataatgttggtgtaatgtgtcattccttaagaattctactgttatataccatttttattaaggtcattgcaataaataaacatgaaaacatacccagaaaaa

SEQ ID NO: 311544 - DNA, 1234 bp, Homo sapiens
ggccgggcgcggtggctcacgcctgtaatcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttcttttggataatgttggtgtaatgtgtcattccttaagaattctactgttatataccatttttattaaggtcattgcaataaataaacatgaaaacatacccagaaaaa

SEQ ID NO: 311545 - DNA, 1400 bp, Homo sapiens
acagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtaaatatttcttactctttgaagtcattggggaattctatttaaattgtgtactgtttgcttctgcctagaactgttcttcactttaaaattttcattgtttcggaaccgagagttatttataaattgctgaatatgcaattctgtggaatctgaaaaatagctcggggagatggatgcatttgcacagatatctgtatgagtagaaactattgcaaggtacttatgctaaatcctccacttctgcagggcttccgtggtgtcattacagaagattcctttaaatcctctctatggctaagggctatagagcatggatatgaacttggggattttttttttcttttgcaggtgcagatgttttatttttaagaccatgttcttttgcatgtgtgtatgtgtctctgtgtgtatgtgtctctgtgtgtgtaactcatcaggactttatttacaaggcatgctatatatgaagggttgtattttagatgatattaaagcttttaaatatgatctttggagctaaggtcccggaactctgcacttatgcccagagagagtgttaaagttagagtaaagtgtaatttgttcttccaaaaaagaactccttgacaactcttgctgaccttgcatatttgtataatttaaacaaatacatactgtatatggaaagcagaaactttctaagagctgcttgcccaacttttctgtttagaagaggactttcatgggcaaagtttggacttggggttctgtgttataaaactctgattttatattcagtgtcgtgaagtccctttaggtaaatctggctgctgctgtcagtgcaccgacttctcgtttccgattgctggccgtagttctagtttccattctcagcaaaattatatccttcaagacttgtgtttttttttcaatttgcaagcgcttttaagctgctgtcactggctccaccgattcaattgcctgagggctcaattcataagacgtctctgccacttagtgcagcattcagttgctgctttcaaacacttcaccactacgactttccctagtcaagtaagtggctccaggagttaaagatacacccttgtcaggcacctgattct

SEQ ID NO: 311546 - DNA, 588 bp, Homo sapiens
caatcaatgaatctgtgatagaagcagatgaatcaaatctcatctttgtgtgattataaagctgtctgtggtattcacgccaccaggggtacatagaagatgcctgagtgaggtttggcaaaagtactaagggcctgtccacctatacatgcccttctcaggaaaaccaaggttcaagctctctattagctcaactggtaaggcgtaagacatggaaggttgaggcccaatgttagaaatagatggatacataaaacttcatcaagttaatgtcactttttctcctttatttataggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatc

SEQ ID NO: 311547 - DNA, 316 bp, Homo sapiens
acatgaggccactctgtttgatttgtgcagacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggtaagcccacctgggtgggatccagccatcctcaagtggtctctctcttgtgcatgtgggtgggccaagcagaaatcctgccccatagtctcctggcttacaag

SEQ ID NO: 311548 - DNA, 1145 bp, Homo sapiens
acagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggttggccaaagacacatccaggaggggaacagaaggaggggacagaagcaagtctgcagatcagaggaaagaagaaagagcagaggagggagattggaagtagaaatgctgaatgcagaggcaaaaaaggaaaatgaaggacaggaggattaaacagacagaggcaaggatgatgagagaggagcagacagcaagaatgaaaagcagaaaatacaatagaggaaatgaagaaaagtaggcctgctggagctagatgatgatgtgatggaaatagaagtaaccttttagagaatctcgctaagaaacatggagaaaacggaaaagaaaaatgtaatgccctagaaagcgcaaagaaagacagtggcaaaaatgaaaaaaaaaataaaaattataaaagaggcaaaaaaagacacactattctctgcctctaaaacacaattaaataaaagaatttaaataaaaa

SEQ ID NO: 311549 - DNA, 7386 bp, Homo sapiens
  misc_feature (5095)..(5095): n is a, c, g, or t
acagtgtctgtgttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagatttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaaccttgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgnttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttcttttggataatgttggtgtaatgtgtcattccttaagaattctactgttatataccatttttattaaggtcattgcaataaataaacatgaaaacatacccagaaaaa

SEQ ID NO: 311550 - DNA, 406 bp, Homo sapiens
ctgcctcctcagcctcattctccattcactcaccatgcttctggagctgcctctcttcctctgctaaaccaagccctttgctgactggatgtgctcagtttcaggagcctgggatcccttctgtcctctcacctgtcagggcttggctcatatgtcaccttctttgatcacccccacagtcaatcagtgcctctttctctctctctctctctatacacacacacacacacagccacacacacagaaaatatactgtaaagaaagagagaaaataaaaagttaaaaagttaaaaaaaaaaaaaaacctgttaactccaagggagcaccacccacagaacctccaccaactgacagtttctcttcttgacttgccacccatctccccagtcttttgtttaacaaaaaa

SEQ ID NO: 311551 - DNA, 2712 bp, Homo sapiens
cgactgaggcggcgggcggagcggcaggcggcggcggcgcggcagcggagcgcagcatcatggcggaccgagacagcggcagcgagcagggtggtgcggcgctgggttcgggcggctccctggggcaccccggctcgggctcaggctccggcgggggcggtggtggcggcgggggcggcggcggcagtggcggcggcggcggcggggccccaggggggctgcagcacgagacgcaggagctggcctccaagcgggtggacatccagaacaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccccagccagccgccggacctggcccaggcgcaggacgagccgcgccgggcgctcaaaagcgagttcctggtgcgcgagaaccgcaagtactacatggatctcaaggagaaccagcgcggccgcttcctgcgcatccgccagacggtcaaccgggggcctggcctgggctccacgcagggccagaccattgcgctgcccgcgcaggggctcatcgagttccgtgacgctctggccaagctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgaggaagaaggggaagaagattgatcaaactgaatgaaacccccacacacacacacatgcatacacacacacacacagccacacacacagaaaatatactgtaaagaaagagagaaaataaaaagttaaaaagttaaaaaaaaaaaaaaacctgttaactccaagggagcaccacccacagaacctccaccaactgacagtttctcttcttgacttgccacccatcgctggatgttgtccactttatccaccatataaaacagtaagcagctgctaaaaacaaaaaaaatacaaaaagtaataacattatatgaactgtgtttcctacttgattaaaaaatataaagaactgagtgtttatttccctaattaaccaagaacttttgtacacgtttaagctattattattaaaaagtgtttgcaaaatggtcaagattataatattgctgaattatataaaagtccttttcatgttgagctaacatttgactttagcacaaaaaagagatattttagaacacgtaaaataatatttttagtttttctcattttgttaccaaatttcaaaccttacatggaggttattatagtatatttgacaccctatatacctgtgattagagatgtgtatatatatgagggctaggcatgctgtgtgtctgagctttgtctaaatgttatgcagaagtttgtagagttaaaggtacgtaggtttaattcatgcaaggtaaacaataagtgctctcttttatacaatatgcattgcatctggaccttaaacttataaaaatggtcagtgaaacttctgtgaacatgaagaaattattaaaaaaggcatttaaatgaaatttgctaagttgtgatttttatggttggaaccaaagttattcaaatagtaaaaggaaaaagaaagaaaaaggagatctcccataatatttttctgcatctgtttgctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagacctgttaaaaagcagagcaacacaattatagttatcctactgagccatggattctgagttttgttttaaaagtgaaagccaagttggtgtatgtaaaggatttccatgtagctgtggtgctagttattactggctacattatatgctaagtgtatttgtgttccccaagtgtacaagccttctatcaaaagtatgttctataactcatatattcaaggtgtagggtatgaaaatgcaaagtttaggagagcactttaccaagctggtgtcctccaaactgaaattgtttgtaacgatagtcttttacaggttttcctttaaagatgtttgtgtgcttttaattgacaactaacttcttgctgctgtatagtaaaatattaatatatttttatcattaaactgctgcatgactatcatctttgagtgaagagaaaatgttataaaaaagatgccttaaacagtacattttggtttggaattctgtagaaagtattttggtaaaaaaaaaaaaaaa

SEQ ID NO: 311552 - DNA, 2614 bp, Homo sapiens
cgactgaggcggcgggcggagcggcaggcggcggcggcgcggcagcggagcgcagcatcatggcggaccgagacagcggcagcgagcagggtggtgcggcgctgggttcgggcggctccctggggcaccccggctcgggctcaggctccggcgggggcggtggtggcggcgggggcggcggcggcagtggcggcggcggcggcggggccccaggggggctgcagcacgagacgcaggagctggcctccaagcgggtggacatccagaacaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccccagccagccgccggacctggcccaggcgcaggacgagccgcgccgggcgctcaaaagcgagttcctggtgcgcgagaaccgcaagtactacatggatctcaaggagaaccagcgcggccgcttcctgcgcatccgccagacggtcaaccgggggcctggcctgggctccacgcagggccagaccattgcgctgcccgcgcaggggctcatcgagttccgtgacgctctggccaagctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgaggaagaaggggaagaagattgatcaaactgaatgaaacccccacacacacacacatgcatacacacacacacacagccacacacacagaaaatatactgtaaagaaagagagaaaataaaaagttaaaaagttaaaaaaaaaaaaaaacctgttaactccaagggagcaccacccacagaacctccaccaactgacagtttctcttcttgacttgccacccatcgctggatgttgtccactttatccaccatataaaacagtaagcagctgctaaaaacaaaaaaaatacaaaaagtaataacattatatgaactgtgtttcctacttgattaaaaaatataaagaactgagtgtttatttccctaattaaccaagaacttttgtacacgtttaagctattattattaaaaagtgtttgcaaaatggtcaagattataatattgctgaattatataaaagtccttttcatgttgagctaacatttgactttagcacaaaaaagagatattttagaacacgtaaaataatatttttagtttttctcattttgttaccaaatttcaaaccttacatggaggttattatagtatatttgacaccctatatacctgtgattagagatgtgtatatatatgagggctaggcatgctgtgtgtctgagctttgtctaaatgttatgcagaagtttgtagagttaaaggtacgtaggtttaattcatgcaaggtaaacaataagtgctctcttttatacaatatgcattgcatctggaccttaaacttataaaaatggtcagtgaaacttctgtgaacatgaagaaattattaaaaaaggcatttaaatgaaatttgctaagttgtgatttttatggttggaaccaaagttattcaaatagtaaaaggaaaaagaaagaaaaaggagatctcccataatatttttctgcatctgtttgctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagacctgttaaaaagcagagcaacacaattatagttatcctactgagccatggattctgagttttgttttaaaagtgaaagccaagttggtgtatgtaaaggatttccatgtagctgtggtgctagttattactggctacattatatgctaagtgtatttgtgttccccaagtgtacaagccttctatcaaaagtatgttctataactcatatattcaaggtgtagggtatgaaaatgcaaagtttaggagagcactttaccaagctggtgtcctccaaactgaaattgtttgtaacgatagtcttttacaggttttcctttaaagatgtttgtgtgcttttaattgacaactaacttcttgctgctgtatagtaaaatattaatatatttttatcattaaactgctgcatgactatca

SEQ ID NO: 311553 - DNA, 1850 bp, Homo sapiens
cgactgaggcggcgggcggagcggcaggcggcggcggcgcggcagcggagcgcagcatcatggcggaccgagacagcggcagcgagcagggtggtgcggcgctgggttcgggcggctccctggggcaccccggctcgggctcaggctccggcgggggcggtggtggcggcgggggcggcggcggcagtggcggcggcggcggcggggccccaggggggctgcagcacgagacgcaggagctggcctccaagcgggtggacatccagaacaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccccagccagccgccggacctggcccaggcgcaggacgagccgcgccgggcgctcaaaagcgagttcctggtgcgcgagaaccgcaagtactacatggatctcaaggagaaccagcgcggccgcttcctgcgcatccgccagacggtcaaccgggggcctggcctgggctccacgcagggccagaccattgcgctgcccgcgcaggggctcatcgagttccgtgacgctctggccaagctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgaggaagaaggggaagaagattgatcaaactgaatgaaacccccacacacacacacatgcatacacacacacacacagccacacacacagaaaatatactgtaaagaaagagagaaaataaaaagttaaaaagttaaaaaaaaaaaaaaacctgttaactccaagggagcaccacccacagaacctccaccaactgacagtttctcttcttgacttgccacccatcgctggatgttgtccactttatccaccatataaaacagtaagcagctgctaaaaacaaaaaaaatacaaaaagtaataacattatatgaactgtgtttcctacttgattaaaaaatataaagaactgagtgtttatttccctaattaaccaagaacttttgtacacgtttaagctattattattaaaaagtgtttgcaaaatggtcaagattataatattgctgaattatataaaagtccttttcatgttgagctaacatttgactttagcacaaaaaagagatattttagaacacgtaaaataatatttttagtttttctcattttgttaccaaatttcaaaccttacatggaggttattatagtatatttgacaccctatatacctgtgattagagatgtgtatatatatgagggctaggcatgctgtgtgtctgagctttgtctaaatgttatgcagaagtttgtagagttaaaggtacgtaggtttaattcatgcaaggtaaacaataagtgctctcttttatacaatatgcattgcatctggaccttaaacttataaaaatggtcagtgaaacttctgtgaacatgaagaaattattaaaaaaggcatttaaatga

SEQ ID NO: 311554 - DNA, 970 bp, Homo sapiens
cgactgaggcggcgggcggagcggcaggcggcggcggcgcggcagcggagcgcagcatcatggcggaccgagacagcggcagcgagcagggtggtgcggcgctgggttcgggcggctccctggggcaccccggctcgggctcaggctccggcgggggcggtggtggcggcgggggcggcggcggcagtggcggcggcggcggcggggccccaggggggctgcagcacgagacgcaggagctggcctccaagcgggtggacatccagaacaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccccagccagccgccggacctggcccaggcgcaggacgagccgcgccgggcgctcaaaagcgagttcctggtgcgcgagaaccgcaagtactacatggatctcaaggagaaccagcgcggccgcttcctgcgcatccgccagacggtcaaccgggggcctggcctgggctccacgcagggccagaccattgcgctgcccgcgcaggggctcatcgagttccgtgacgctctggccaagctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcggtctcctcctgctgctgctgttgctgctggtgaagctgcgtcgac

SEQ ID NO: 311555 - DNA, 1139 bp, Homo sapiens
cgactgaggcggcgggcggagcggcaggcggcggcggcgcggcagcggagcgcagcatcatggcggaccgagacagcggcagcgagcagggtggtgcggcgctgggttcgggcggctccctggggcaccccggctcgggctcaggctccggcgggggcggtggtggcggcgggggcggcggcggcagtggcggcggcggcggcggggccccaggggggctgcagcacgagacgcaggagctggcctccaagcgggtggacatccagaacaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccccagccagccgccggacctggcccaggcgcaggacgagccgcgccgggcgctcaaaagcgagttcctggtgcgcgagaaccgcaagtactacatggatctcaaggagaaccagcgcggccgcttcctgcgcatccgccagacggtcaaccgggggcctggcctgggctccacgcagggccagaccattgcgctgcccgcgcaggggctcatcgagttccgtgacgctctggccaagctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgaggaagaaggggaagaagattgatcaaactgaatgaaacccccacacacacacacatgcatacacacacacacacagccacacacacagaaaatatactgtaaagaaagagagaaaataaaaagttaaaaagtt

SEQ ID NO: 311556 - DNA, 2654 bp, Homo sapiens
cgactgaggcggcgggcggagcggcaggcggcggcggcgcggcagcggagcgcagcatcatggcggaccgagacagcggcagcgagcagggtggtgcggcgctgggttcgggcggctccctggggcaccccggctcgggctcaggctccggcgggggcggtggtggcggcgggggcggcggcggcagtggcggcggcggcggcggggccccaggggggctgcagcacgagacgcaggagctggcctccaagcgggtggacatccagaacaagcgcttctacctggacgtgaagcagaacgccaagggccgcttcctgaagatcgccgaggtgggcgcgggcggcaacaagagccgccttactctctccatgtcagtggccgtggagttccgcgactacctgggcgacttcatcgagcactacgcgcagctgggccccagccagccgccggacctggcccaggcgcaggacgagccgcgccgggcgctcaaaagcgagttcctggtgcgcgagaaccgcaagtactacatggatctcaaggagaaccagcgcggccgcttcctgcgcatccgccagacggtcaaccgggggcctggcctgggctccacgcagggccagaccattgcgctgcccgcgcaggggctcatcgagttccgtgacgctctggccaagctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgaggaagaaggggaagaagattgatcaaactgaatgaaacccccacacacacacacatgcatacacacacacacacagccacacacacagaaaatatactgtaaagaaagagagaaaataaaaagttaaaaagttaaaaaaaaaaaaaaacctgttaactccaagggagcaccacccacagaacctccaccaactgacagtttctcttcttgacttgccacccatcgctggatgttgtccactttatccaccatataaaacagtaagcagctgctaaaaacatataaagaactgagtgtttatttccctaattaaccaagaacttttgtacacgtttaagctattattattaaaaagtgtttgcaaaatggtcaagattataatattgctgaattatataaaagtccttttcatgttgagctaacatttgactttagcacaaaaaagagatattttagaacacgtaaaataatatttttagtttttctcattttgttaccaaatttcaaaccttacatggaggttattatagtatatttgacaccctatatacctgtgattagagatgtgtatatatatgagggctaggcatgctgtgtgtctgagctttgtctaaatgttatgcagaagtttgtagagttaaaggtacgtaggtttaattcatgcaaggtaaacaataagtgctctcttttatacaatatgcattgcatctggaccttaaacttataaaaatggtcagtgaaacttctgtgaacatgaagaaattattaaaaaaggcatttaaatgaaatttgctaagttgtgatttttatggttggaaccaaagttattcaaatagtaaaaggaaaaagaaagaaaaaggagatctcccataatatttttctgcatctgtttgctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagacctgttaaaaagcagagcaacacaattatagttatcctactgagccatggattctgagttttgttttaaaagtgaaagccaagttggtgtatgtaaaggatttccatgtagctgtggtgctagttattactggctacattatatgctaagtgtatttgtgttccccaagtgtacaagccttctatcaaaagtatgttctataactcatatattcaaggtgtagggtatgaaaatgcaaagtttaggagagcactttaccaagctggtgtcctccaaactgaaattgtttgtaacgatagtcttttacaggttttcctttaaagatgtttgtgtgcttttaattgacaactaacttcttgctgctgtatagtaaaatattaatatatttttatcattaaactgctgcatgactatcatctttgagtgaagagaaaatgttataaaaaagatgccttaaacagtacattttggtttggaattctgtagaaagtattttggtaaaaaaaaaaaaaaa

SEQ ID NO: 311557 - DNA, 2287 bp, Homo sapiens
aggcaatttcattcaccctggcggcgacacacaggaagcccgcttcagtcaccctcgacccccagttatgagtaagaccagacaatccctttcctccgacagtcccacgtttgcttccaggaatcaaagagcatgccagtggcagctatctgtggcacttttgggaaagtgaaaggagatgctattccagcactgctctgtcaccttagatgagccaaccgttgactagtactagtccacggttggctcatcgacgactacggagtggaggaggagccggccgagctgcccgagggcacctccttgactgtggacaacaagcgcttcttcttcgatgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgaggaagaaggggaagaagattgatcaaactgaatgaaacccccacacacacacacatgcatacacacacacacacagccacacacacagaaaatatactgtaaagaaagagagaaaataaaaagttaaaaagttaaaaaaaaaaaaaaacctgttaactccaagggagcaccacccacagaacctccaccaactgacagtttctcttcttgacttgccacccatcgctggatgttgtccactttatccaccatataaaacagtaagcagctgctaaaaacaaaaaaaatacaaaaagtaataacattatatgaactgtgtttcctacttgattaaaaaatataaagaactgagtgtttatttccctaattaaccaagaacttttgtacacgtttaagctattattattaaaaagtgtttgcaaaatggtcaagattataatattgctgaattatataaaagtccttttcatgttgagctaacatttgactttagcacaaaaaagagatattttagaacacgtaaaataatatttttagtttttctcattttgttaccaaatttcaaaccttacatggaggttattatagtatatttgacaccctatatacctgtgattagagatgtgtatatatatgagggctaggcatgctgtgtgtctgagctttgtctaaatgttatgcagaagtttgtagagttaaaggtacgtaggtttaattcatgcaaggtaaacaataagtgctctcttttatacaatatgcattgcatctggaccttaaacttataaaaatggtcagtgaaacttctgtgaacatgaagaaattattaaaaaaggcatttaaatgaaatttgctaagttgtgatttttatggttggaaccaaagttattcaaatagtaaaaggaaaaagaaagaaaaaggagatctcccataatatttttctgcatctgtttgctttgactgagtaggcgttttgtcattattgtgtatatgagatgtacttgtatcgttcataatatattttttttattatgtgtagaaagattttaaaaaactaacgtgcagcaatttccagtgaacctgtacttggacatcaggtagtgagtctatttgtggtcactagcactgtctcctaaacttgtaagaggtctgaagctattctttgatttttgctagtgctattaacttatgtagacctgttaaaaagcagagcaacacaattatagttatcctactgagccatggattctgagttttgttttaaaagtgaaagccaagttggtgtatgtaaaggatttccatgtagctgtggtgctagttattactggctacattatatgctaagtgtatttgtgttccccaagtgtacaagccttctatcaaaagtatgttctataactcatatattcaaggtgtagggtatgaaaatgcaaagtttaggagagcactttaccaagctggtgtcctccaaactgaaattgtttgtaacgatagtcttttacaggttttcctttaaagatgtttgtgtgcttttaattgacaactaacttcttgctgctgtatagtaaaatattaatatatttttatcattaaactgctgcatgactatcatctttgagtgaagagaaaatgttataaaaaagatgccttaaacagtacattttggtttggaattctgtagaaagtattttggtaaaaaaaaaaaaaaa

SEQ ID NO: 311558 - DNA, 5227 bp, Homo sapiens
ggccgtaatctgactcccagcacacagggagctgcggggcaggcaatgagagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaactgagtttaacaatggcaaaatacagtatgtcacagtcatgcacattcaagagagaaaatataacaagttcttttatgagcaatcccttatgcatagactaccttggcaaaagagcattagcaagtgtcactgctcatcagttacttccttccatttatatcacaaatacccaagtttcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagatgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgtattaggagactggggcttttttctttaatcccttcttattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttattttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcacttttatgacccaaatcacaataaaattgtcatttaggataaactggggagaatagactgaacatatggttatattcacagttatttattaacttaaatgttattccaacattagagctaatgttaaaaagatttaaactgtaacgtctaatatttggaataatatattaaagtattagcactgtggttgattttcttgaattatgttgcatcttgtactactaagcttgtgaaaataaacatttggatgttttaaaaggtaaacattatgtttgat

SEQ ID NO: 311559 - DNA, 5170 bp, Homo sapiens
ggccgtaatctgactcccagcacacagggagctgcggggcaggcaatgagagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaactgagtttaacaatggcaaaatacagtatgtcacagtcatgcacattcaagagagaaaatataacaagttcttttatgagcaatcccttatgcatagactaccttggcaaaagagcattagcaagtgtcactgctcatcagttacttccttccatttatatcacaaatacccaagtttcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagatgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgtattaggagactggggcttttttctttaatcccttcttattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttattttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtatttctaggttctcttcaggattaattaaataaacatgcaatttatgaaaacatataaacaattatttatcacttttatgacccaaatcacaataaaattgtcatttaggataaactggggagaatagactgaacatatggttatattcacagttatttattaacttaaatgttattccaacattagagctaatgttaaaaagatttaaactgtaacgtctaatatttggaataatatattaaagtattagcactgtggttgattttcttgaattatgttgcatcttgtactactaagcttgtgaaaataaacatttggatgttttaaaaggtaaacattatgtttgat

SEQ ID NO: 311560 - DNA, 4879 bp, Homo sapiens
  misc_feature (157)..(157): n is a, c, g, or t
cctttctagggacagtttggataattttccgtgaaactggatgatctttgaatattaaatgaaaggagactagaataacagtctcttgactattcatgaaggagctttagcagaagcattctttcttggtgtgaaatcacgcctgcagcccctgccnacagtacccgaagatgcaggccttgttcccttcacctaaattcataaacctgggtgtagtggcttctgatgctgatttgtttctcttttcagtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagatgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgtattaggagactggggcttttttctttaatcccttcttattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttattttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcactt

SEQ ID NO: 311561 - DNA, 4594 bp, Homo sapiens
agcatctttagctattttcaaactaggactccaagcttcttgcaaactctttgctaaataatgccttggtggcatgaggcacatccctaaaatagctaatttactcctagggaatttttgatgattcttaatagtgtgaaaactgattctggcagtatttaggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaactgagtttaacaatggcaaaatacagtatgtcacagtcatgcacattcaagagagaaaatataacaagttcttttatgagcaatcccttatgcatagactaccttggcaaaagagcattagcaagtgtcactgctcatcagttacttccttccatttatatcacaaatacccaagtttcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagatgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgtattaggagactggggcttttttctttaatcccttcttattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttattttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcactt

SEQ ID NO: 311562 - DNA, 4253 bp, Homo sapiens
ccatttatatcacagatacccaagtatcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaactgagtttaacaatggcaaaatacagtatgtcacagtcatgcacattcaagagagaaaatataacaagttcttttatgagcaatcccttatgcatagactaccttggcaaaagagcattagcaagtgtcactgctcatcagttacttccttccatttatatcacaaatacccaagtttcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagatgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgtattaggagactggggcttttttctttaatcccttcttattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttattttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcactt

SEQ ID NO: 311563 - DNA, 2069 bp, Homo sapiens
  misc_feature (24)..(24): n is a, c, g, or t
acattcagctcggacccactttcngagtaggagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgtattaggagactggggcttttttctttaatcccttcttattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttattttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcacttttatgacccaaatcacaataaaattgtcatttaggataaactggggagaatagactgaacatatggttatattcacagttatttattaacttaaatgttattccaacattagagctaatgttaaaaagatttaaactgtaacgtctaatatttggaataatatattaaagtattagcactgtggttgattttcttgaattatgttgcatcttgtactactaagcttgtgaaaataaacatttggatgttttaaaaggtaaacattatgtttgat

SEQ ID NO: 311564 - DNA, 1687 bp, Homo sapiens
ctgctgacagatacacagagaagagatcagtggtctcctgcacactatgcacttcattaataagaagggattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttattttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcacttttatgacccaaatcacaataaaattgtcatttaggataaactggggagaatagactgaacatatggttatattcacagttatttattaacttaaatgttattccaacattagagctaatgttaaaaagatttaaactgtaacgtctaatatttggaataatatattaaagtattagcactgtggttgattttcttgaattatgttgcatcttgtactactaagcttgtgaaaataaacatttggatgttttaaaaggtaaacattatgtttgat

SEQ ID NO: 311565 - DNA, 1130 bp, Homo sapiens
  misc_feature (24)..(24): n is a, c, g, or t
acattcagctcggacccactttcngagtaggaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcacttttatgacccaaatcacaataaaattgtcatttaggataaactggggagaatagactgaacatatggttatattcacagttatttattaacttaaatgttattccaacattagagctaatgttaaaaagatttaaactgtaacgtctaatatttggaataatatattaaagtattagcactgtggttgattttcttgaattatgttgcatcttgtactactaagcttgtgaaaataaacatttggatgttttaaaaggtaaacattatgtttgat

SEQ ID NO: 311566 - DNA, 4953 bp, Homo sapiens
ggccgtaatctgactcccagcacacagggagctgcggggcaggcaatgagagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaactgagtttaacaatggcaaaatacagtatgtcacagtcatgcacattcaagagagaaaatataacaagttcttttatgagcaatcccttatgcatagactaccttggcaaaagagcattagcaagtgtcactgctcatcagttacttccttccatttatatcacaaatacccaagtttcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagatgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgtattaggagactggggcttttttctttaatcccttcttattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttattttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcactt

SEQ ID NO: 311567 - DNA, 5096 bp, Homo sapiens
ggccgtaatctgactcccagcacacagggagctgcggggcaggcaatgagagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaactgagtttaacaatggcaaaatacagtatgtcacagtcatgcacattcaagagagaaaatataacaagttcttttatgagcaatcccttatgcatagactaccttggcaaaagagcattagcaagtgtcactgctcatcagttacttccttccatttatatcacaaatacccaagtttcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagatgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgtattaggagactggggcttttttctttaatcccttcttattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattaattaaataaacatgcaatttatgaaaacatataaacaattatttatcacttttatgacccaaatcacaataaaattgtcatttaggataaactggggagaatagactgaacatatggttatattcacagttatttattaacttaaatgttattccaacattagagctaatgttaaaaagatttaaactgtaacgtctaatatttggaataatatattaaagtattagcactgtggttgattttcttgaattatgttgcatcttgtactactaagcttgtgaaaataaacatttggatgttttaaaaggtaaacattatgtttgat

SEQ ID NO: 311568 - DNA, 5173 bp, Homo sapiens
ggccgtaatctgactcccagcacacagggagctgcggggcaggcaatgagagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaactgagtttaacaatggcaaaatacagtatgtcacagtcatgcacattcaagagagaaaatataacaagttcttttatgagcaatcccttatgcatagactaccttggcaaaagagcattagcaagtgtcactgctcatcagttacttccttccatttatatcacaaatacccaagtttcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagatgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatataaataattttcttttaatctttattttgctcaatatttaataggaagtatgatttcaaggactactaaaggaaggcaatatacatgtgaaaaccataaaatacattttttgcattctactatttttaggggcatgaaatgaatgaaagctttagcacttttttgcccctacatatgagacaacatattttgtatttcactcaaggctctgccagtaaaaagtaatgaaattgtacctttctaatgacatctatgcagcaggggtctatcgccttgtggatggcaccaaattatccaagtgtattaggagactggggcttttttctttaatcccttcttattaatgaagtgcatagtgctgctcccaggagaccactgctgacagatacacagagaagagatcagagaggaaaaactgggaagacataaatgaattatacccagccatgaaacaatgccaactgtctcttccctaaggaagagtacaagtaccctaaaattgaaaggtggtccctacactgaaaacgcacatagtttgtcaaaagtgtacaaaagggaaagagtcttattttaagctttcaggctttcttaaaaacttggggaccagaatttcaatgtatgtttccattgttgaagataacattttcttcaaagagccttaaccttttgtactggaaggaaatattttctggacttaagtagttgcctaaatttaagattcctacactttatttctgccattgatgcttttcctaaacccttatactatctttttattatctgagccttttcctaatgcagctcataggtgctagctagagctgctgctcagtattgaagactttacaaggagattagaaatctttggaaaacatatgtgatgaaattgagctatatgatttatcagagatctgattccaaagagcacagaatactgttctcagaccatgaaaccagacaacacatgtattggtttaaactcgataatgacaggaaaattccaaactagagcagtaaattcaaatggtaagatgaatcctagaaggcctctgattgcagcatgttgacaccaacctcacgttacgaacaattcacagagaatttgcctttgtggcaactgaagatggaagtctggggggcacagacaaccttatcaaacaatataaaagccaatataaattctcataagcactatagaatttgcaaattcagaacattttatacctaaaagtaattctgtctttcctaaagtgtttttaacatgaaaattagtaggaagatgtggttactatttggaaagtgtaatgtaacaaaactctcttttgttaccacaaattttgtgagtttagtactctacagattgccccataagagcagtagcttttgaaactcataattctctgaaataaatgaaagacatttaattcaaggatcaaaaattgtggccatctttgcaaatgactacctatagcctgtgaaaatacatttcaaaaaatgttatgtgcaatgaacactaaatttaagagcagttacagtgtgactcactcatgtttaaaaaaaatcgaagagctaaaaaatacgtctaatttatgtaacccattggaatgtatttctaggttctcttcaggattatgacccaaatcacaataaaattgtcatttaggataaactggggagaatagactgaacatatggttatattcacagttatttattaacttaaatgttattccaacattagagctaatgttaaaaagatttaaactgtaacgtctaatatttggaataatatattaaagtattagcactgtggttgattttcttgaattatgttgcatcttgtactactaagcttgtgaaaataaacatttggatgttttaaaaggtaaacattatgtttgat

SEQ ID NO: 311569 - DNA, 3272 bp, Homo sapiens
ggccgtaatctgactcccagcacacagggagctgcggggcaggcaatgagagctgcactctggctggggaaggcatgagtgacagacccacagcaaggcggtggggtaagtgtggacctttgtgtaccagagagaacatcatggtggctttcaaaggggtctggactcaagctttctggaaagcagtcacagcggaatttctggccatgcttatttttgttctcctcagcctgggatccaccatcaactggggtggaacagaaaagcctttaccggtcgacatggttctcatctccctttgctttggactcagcattgcaaccatggtgcagtgctttggccatatcagcggtggccacatcaaccctgcagtgactgtggccatggtgtgcaccaggaagatcagcatcgccaagtctgtcttctacatcgcagcccagtgcctgggggccatcattggagcaggaatcctctatctggtcacacctcccagtgtggtgggaggcctgggagtcaccatggttcatggaaatcttaccgctggtcatggtctcctggttgagttgataatcacatttcaattggtgtttactatctttgccagctgtgattccaaacggactgatgtcactggctcaatagctttagcaattggattttctgttgcaattggacatttatttgcaatcaattatactggtgccagcatgaatcccgcccgatcctttggacctgcagttatcatgggaaattgggaaaaccattggatatattgggttgggcccatcataggagctgtcctcgctggtggcctttatgagtatgtcttctgtccagatgttgaattcaaacgtcgttttaaagaagccttcagcaaagctgcccagcaaacaaaaggaagctacatggaggtggaggacaacaggagtcaggtagagacggatgacctgattctaaaacctggagtggtgcatgtgattgacgttgaccggggagaggagaagaaggggaaagaccaatctggagaggtattgtcttcagtatgactagaagatcgcactgaaagcagacaagactccttagaactgtcctcagatttccttccacccattaaggaaacagatttgttataaattagaaatgtgcaggtttgttgtttcatgtcatattactcagtctaaacaataaatatttcataatttacaaaggaggaacggaagaaacctattgtgaattccaaatctaaaaaaagaaatatttttaaaatgttcttaagcaaatatatacctattttatctagttacctttcattaacaaccaattttaaccgtgtgtcaagatttggttaagtcttgcctgacagaactcaaagacacgtctatcagcttattccttctctactggaatattggtatagtcaattcttatttgaatatttattctattaaactgagtttaacaatggcaaaatacagtatgtcacagtcatgcacattcaagagagaaaatataacaagttcttttatgagcaatcccttatgcatagactaccttggcaaaagagcattagcaagtgtcactgctcatcagttacttccttccatttatatcacaaatacccaagtttcaattctaacttcatttcatggtatttcttcctcctcaatgcccaaggtaatgtgggactaaagcccagaaatttgaaaagaatattcagaaatccttcccaaatcataagggcacctattgagattcaagacaagcagactcgtaaaatcttgtagaggcagaggcaaagttatcatcatacaaaaatcacaaacaaaaaggagatctgtattcgggtatcaaacggttgatctgttttcagtgcacaccctcaaatgcaccacaccagttttacgatctaagcttttaacccctttaccactttgcttatttttaaaaaatttattggcaaaactggggattttgtttgtaactttggttatctatatttaaacattagatgagacatatttttgataacaagaacttagctagttgagtcctggctttttgttgattattaagctgtgttcactctagaaggtgtaaaggccctgtcccaatctctgctctctcacttctcgtgacatttgttgataatctttactgcaagtgtaatgatatttgagtgaattaaaatgcatgacagacaaggtacaacatggttgcagaataaaagggtgaggacatcagatcactctgtattcaaagcttactagacgaacaatctttcatttctggatatattgtagctaacccaacacatttttaaactatttttgttactgactcacttacttgtcaaaataattggtttttctgtcctgctttgccttttgtcactagaatgttctccagaaaccccagtttctgtcatcttaactgtctagtctagccgttaacttagacaaagaagtgcaaatgtcaatttcactaaacaaaagctattagaagtaaagcagaaacctatcactgcaaggagtgacttgtaaataactgatgatcaagggctgtcttctctcaagcatggttccaactctgtgtcactttttagcgttaatggcagttgtgtgtctgtggcagtgagataatggaccactattaaacctgattctcttcggtgctaggaaagagtgatgtgtgagattcccagagagtcgtcacaccagtgttatgcctgggagtgccactggcataccgcaggtgcctaaatcccaggcccctttctcagggggcgtggccacaccacacactgcgccagtgacacatagttacttcctggctgggacggcacctatagaaactagggtacaaatctcccaaagatggtttgcaccgtcatttcaaatgtttgcacaatataccacttagaggcttaaaatcagggtggttcagttcaaaaggtaatatcaaccgtcagcaaacatgtcagtttaaaaataagttcggttaacaaggaagtgttaagcagattttttgaatacacttacaatatactggcttataatcatttttattctgccatatggtttatttcatatacactcacttttacactcacttccaattatagcattcaataagttacggttaaagaaaagtgaatggtgtttttgtaatttgttttctagtagctagcagagagcctggcacatagtatgtattcaaaacaagtgtgttaattaataaaaatatataaatctcatttgagatttaagaatata

SEQ ID NO: 311570 - DNA, 559 bp, Homo sapiens
tcagtcggtaccagcagtacgctcatcaactacatggcaagttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcattggtttatttttcaatgcatctttaatttgtaaagaaataaaataaattaagatgtaa

SEQ ID NO: 311571 - DNA, 422 bp, Homo sapiens
  misc_feature (39)..(39): n is a, c, g, or t
  misc_feature (370)..(371): n is a, c, g, or t
gaacatcgagctcgcaccctgccatttactccatggccnagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgagtgcctttcctcctgaccattctgnngctgctgccaaggtaagttcttatgacccatttgttcctgatgccacctct

SEQ ID NO: 311572 - DNA, 4531 bp, Homo sapiens
gaaccggaagtggagcctgggagccttgacgttaggaacgaagtctaacctggatctggagccgggagataatctgaatgctggctggggcagaaaattactaagatcctgtggaagtgtgaggattattaaactgatcactgtctgataaggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311573 - DNA, 4444 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311574 - DNA, 5028 bp, Homo sapiens
  misc_feature (5026)..(5026): n is a, c, g, or t
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaaaaaaaaaaaaaaaaaaaaaaaaaaaaaaaaaaaaagaaaaaacaaacaaaaaaagaggggggcgagccacactaaagaaatattccccccagagggggcgccacaaaatcaagaacgcgcggtcaccgcccggatatgtacgcgaaaacaagagggggcccccctattagagagcggcgccgtcataaaaacacacaggaaagcagggccgacttgaaaacaaacgggtgatgacgggggagaaaacgccggatacgaggggggacacaccttaggaggaggcgaggcccctaacactccgggggggggggcacacttggggggaccagtcgccccctccagagtattaagcgcccactgagggagaaccttaaagggtcaacgcggcaaccggggtgttaacacacccgcggcaaattgctgcggcgggctatgagagagtgcggcccaagggagtattttctaggggaaagattttttaccccgcggggcttggtcagaaaaacgcgggctgtggagggacacatatgagatccggagatcagtatatattcaatcgcgaccatgggagaagaggggggnat

SEQ ID NO: 311575 - DNA, 5269 bp, Homo sapiens
  misc_feature (5263)..(5263): n is a, c, g, or t
  misc_feature (5265)..(5265): n is a, c, g, or t
  misc_feature (5269)..(5269): n is a, c, g, or t
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaaccattagcctcatctttactcccgaaagctcactttgcttttagtcctggccgtcggctgagcgagctgcgcatgcgccacgtgcccccgtggcgtagggcctcgtccggtcacgactatccgctgggcggggtcggtgctggccgagggggcgccggctgccggagtggacatggcggccggccccattagggtggtgttggtccttctaggggtgctcagtgtctgtgcagccagcggccatgggtccgtagcggagagggaggccggcggggaggcggagtgggcggaaccgtgggatggcgcggttttccggccgccctcggcgctgggcgcagtgggggtgacgcgcagctctgggacgccgcggccagggagggaggaggcgggggacttgccggtactgctgtggtggagcccagggctattcccccacttcccgggagactcggagcgcatcgagtgtgcgcgcggcgcgtgcgtggcgtcccggaaccgccgagcgctgagggactcgcggacgcgcgcgctgctcttctacggcacagacttccgcgcgtcggccgccccgctgccgcgcctggcgcaccagagctgggcgctcctccacgaggagtcgcccctcaacaacttcttgctgagccacggcccgggcatccgcctcttcaatcttacctccaccttcagtcgccactcggattacccgctgtcgctgcagtggctgcccgggaccgcctatctgcgccgcccggtgcctccgcccatggaacgcgcggagtggcgccgccgcggctacgcgccgctgctctatctgcaccncntgcn

SEQ ID NO: 311576 - DNA, 3257 bp, Homo sapiens
  misc_feature (24)..(24): n is a, c, g, or t
tgctgcttctcctcctcgggtttnttggggagagaggcagagccagctggagcgccgttctctcctgctgggacaccgcttgggctttggtattgactgagtggctgatagttatcttccaaccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311577 - DNA, 4708 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttggtgcgattgagggttggagtatgagatcttgcacggagcaaagggcctcttaggaggaggaaaggataggctagtatcagtcagacactagtggaatttgtttttatgtattttagctgatgtaattttcacactgagagagttactgagaccccagaaggggtggtgtctgaggacttagctttcaaaattttgtgtgtggtgcgggggggcagacttgtcttatggtccttggtaaccttttgctcccttccttttgtctagacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311578 - DNA, 4371 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311579 - DNA, 4302 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311580 - DNA, 4360 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgggatgcccctgctctggacctctcatttctcttcattggtttatttttcaatgcatctttaatttgtaaagaaataaaataaattaagatgtaa

SEQ ID NO: 311581 - DNA, 1832 bp, Homo sapiens
tcagtcggtaccagcagtacgctcatcaactacatggcaagttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311582 - DNA, 4142 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311583 - DNA, 4394 bp, Homo sapiens
  misc_feature (4076)..(4076): n is a, c, g, or t
  misc_feature (4078)..(4078): n is a, c, g, or t
  misc_feature (4084)..(4084): n is a, c, g, or t
  misc_feature (4093)..(4093): n is a, c, g, or t
  misc_feature (4135)..(4135): n is a, c, g, or t
  misc_feature (4162)..(4162): n is a, c, g, or t
  misc_feature (4225)..(4225): n is a, c, g, or t
  misc_feature (4230)..(4230): n is a, c, g, or t
  misc_feature (4239)..(4239): n is a, c, g, or t
  misc_feature (4244)..(4244): n is a, c, g, or t
  misc_feature (4249)..(4249): n is a, c, g, or t
  misc_feature (4261)..(4261): n is a, c, g, or t
  misc_feature (4268)..(4268): n is a, c, g, or t
  misc_feature (4287)..(4287): n is a, c, g, or t
  misc_feature (4298)..(4299): n is a, c, g, or t
  misc_feature (4324)..(4324): n is a, c, g, or t
  misc_feature (4342)..(4342): n is a, c, g, or t
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtgatcatcaatcattgcaggagagagcgagcgagcagtgaatgtattggtggtgctctcctccagagctggggttgttcgggcttctggcagcctttctcaaaccatttcccccactccagggtccccctggctctgctggtgctcctggcaagatggactcaacggtctccctggcccattgggcccctggtcctcgcggtcgcncnggtgangctggtccngttgtatgtaggccctcatccctctgctcatggcctccagcncccaaagcaccttggatgccggtaatnccccatctctttccctctctgtgcaaggggtcccccccggcctcctggacctcctggtccccnggtcncccagcgcnggttncgacntcagctccggcncaaggcnaccctcaagagaaggcccncgattgtggcnnttactaccgggtctgaataagccangtggttcgtggcctactncgagtgaaccaccctgagagcacaccatacagggatccctaaatcaccgcag

SEQ ID NO: 311584 - DNA, 3926 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctgggatgcccctgctctggacctctcatttctcttcattggtttatttttcaatgcatctttaatttgtaaagaaataaaataaattaagatgtaa

SEQ ID NO: 311585 - DNA, 2670 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311586 - DNA, 3584 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgcccttcagggagatgggggtcaataaaggcaactgaacattga

SEQ ID NO: 311587 - DNA, 1204 bp, Homo sapiens
ggacgcgtgggtccggacgcgtgggtcgcggacgcgtgggtcgacccacgcgtccgagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311588 - DNA, 833 bp, Homo sapiens
ccctgactgcagctctcctcttgggagactggtccaaagggacacataatattgccagggtctgggtgcctccaaacccccaataccgaatcatatacagtgaactgagaagctacattcattatgacaggattatggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311589 - DNA, 477 bp, Homo sapiens
ctgaagaagtgagcccgagaatgtggcagttaggaacatgggccttggaatcagtcctgcattgatattctggccccaccacttactagctacatgacctaggataaatttcttaagtacttcctcttttgttccttcatctgcaaaatggtgttaaaatacttaagtaggatttgtcaacagaattaaataattatatgtaaagcactctgtgtggtacctggcatgcagtctaagtgtttaaaagctattattgtcatcatcattatcatcctcactgttatgatgatgataattaggtggccttgtagagtggaaggggtacagggagattgtctgcacgatgagctatgtctagtcagtgacatgactctggacctgggggcctgcaggtggagaacgaccaggagcggttcctgagtgacctgcgtcgtgatgtccagaaggttgttggctttgatgctgtgatgcgggtcc

SEQ ID NO: 311590 - DNA, 409 bp, Homo sapiens
gtgagagttacagaactgaggtgtttcctgaggttaatgatagggtgtctgggttgactgaagaaatgtagcttggtgtcatgaagttgtgggtggtggaaaaggtggcaagtctaggtaacaatgtcaccttctacagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccaggtaagagccagattgtggaggtaaaggttgggggtggcatgggtaccaccatagaaggtcatggagttgaacagaggt

SEQ ID NO: 311591 - DNA, 325 bp, Homo sapiens
gctcgttcctcttcctccgtctctcctcactatgcgtactgtgcctgcggggtctgcgtctagacgtctgactctgcagtgcatgtacatttgtttgctggctcgtctatatgacaacgtacgagacgtagtgtagaacctcgtgcgtgggctagatggggacaaaacagtgactgtggagttcaagcatgacgatcggctcaatgaagagagcggagctctcctgcaggccctgctttacaccagctgtgcaggtggcaggcgggaggcggggctgggcaggaagtgtttcattcgcttggtatagaagagggtgaggaatggg

SEQ ID NO: 311592 - DNA, 4398 bp, Homo sapiens
ctcctctctctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311593 - DNA, 4225 bp, Homo sapiens
ctcctctctctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311594 - DNA, 4681 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttggtgagggcagggagtcaaggagaatatgggtgtggaagtatactttgtgaaacaattgggagccaatatagttagtgtgctagtaccctcaaatatcagggaacacttggggacaagggcagttgctgtcattcttcccaggtttgcctgtttcagatgatgcatacatgtatgctgccccaccttgactgaactcagagtgccttaccataaggataaatgaattttgtgttctagagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311595 - DNA, 4497 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttggtgagggtagaagcagggcagggtgggattggggctgagaggtccaggatggtgagtgggtagttgtgatggtgggaatgcacacatgatgggcagctgaccagtgactatctttgctttcccatccagcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311596 - DNA, 4361 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311597 - DNA, 4945 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagatcagcggtgctgtggccccagcccctccttcttcagggctgggctttggcccaccaacatcgctggcttcagcctcaggaagtttccctaactctggtctgtatggctcctatcctcagggccaggctcctccccttagccaggcccaaggtcatcctgggatccagactccccagcgatctgccccatcacaggcctccagcttcacacccccagcttcagggggtcctcggctgccttcgatgactggtccactcctgcctggacagagttttggagggccctcagtgagccagcccaaccatgtgtcttcacctcctcaagctctgccccctggcacccagatgactgggcccctgggaccactgccacctatgcactccccgcagcagccaggctatcagccccaacaaaatggttccttcggaccagcccggggccctcagtctaattatggaggcccctacccagcagcacccacctttggcagtcagcctgggcctcctcagccactgcctcctaagcgcctggaccctgatgccatcccaagccctattcaggtcattgaagatgacaggaacaaccggggtacagagccatttgttactggagtacggggccaggtgccacccttagtcactaccaacttcctggtgaaagaccaagggaatgcaagtccccgatacatccgatgtacatcctataatatcccttgcacatctgacatggctaagcaggctcaggtgcccctggcagcagtcatcaaaccgctggcaaggctgcccccagaggaggcttcaccgtatgttgtggaccatggggaatctggccctttgcgctgcaaccgctgcaaagcatacatgtgtcccttcatgcagttcattgaaggagggaggcgtttccagtgctgtttttgcagctgtatcaatgatgttcccccccagtattttcagcacctggatcataccggcaaacgtgtggatgcttatgaccgccctgagctatccctgggctcttatgaattcttggccactgtagattactgcaagaacaataagttccccagccctcctgcctttatcttcatgattgacgtctcctacaatgccatcaggactggtcttgttaggctcctctgtgaggagctcaagtcactgttagactttctacctagggagggtggggcagaagagtcagcaatccgcgttggctttgtcacctacaataaggtgctccacttctataatgtgaagagctcattggcccagccacagatgatggttgtgtctgatgtggctgacatgtttgtgccactgctggatggcttcctggtcaacgtcaatgagtctcgggcagttatcaccagcttattggatcagattccagaaatgtttgcagacacaagggaaacagagacagtatttgtaccagttatccaggctggaatggaggctctgaaggctgctgagtgtgcagggaagctctttctattccatacatccctgcccattgcagaggccccagggaaactgaagaacagagatgacaggaagctgatcaatacagacaaggagaagactctgttccagcctcagacaggtgcctatcagaccctggccaaagagtgtgtggcccaaggctgctgtgtagatctctttctcttccctaaccagtatgtggatgtggccacactctctgttgtgccccagctcactggtggctctgtctacaaatatgcttcctttcaggtggagaacgaccaggagcggttcctgagtgacctgcgtcgtgatgtccagaaggttgttggctttgatgctgtgatgcgggtccggacaagcactggtatccgtgctgtagatttctttggagctttctacatgagcaacacgacagatgtggagctggctgggctagatggggacaaaacagtgactgtggagttcaagcatgacgatcggctcaatgaagagagcggagctctcctgcagtgtgccctgctttacaccagctgtgcagggcagcgtcggctccgcatccataatctggccctgaactgctgcacccagctggctgatctatatcgaaactgtgagactgacacgctcatcaactacatggccaagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttggtgcgattgagggttggagtatgagatcttgcacggagcaaagggcctcttaggaggaggaaaggataggctagtatcagtcagacactagtggaatttgtttttatgtattttagctgatgtaattttcacactgagagagttactgagaccccagaaggggtggtgtctgaggacttagctttcaaaattttgtgtgtggtgcgggggggcagacttgtcttatggtccttggtaaccttttgctcccttccttttgtctagacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttggtgagggcagggagtcaaggagaatatgggtgtggaagtatactttgtgaaacaattgggagccaatatagttagtgtgctagtaccctcaaatatcagggaacacttggggacaagggcagttgctgtcattcttcccaggtttgcctgtttcagatgatgcatacatgtatgctgccccaccttgactgaactcagagtgccttaccataaggataaatgaattttgtgttctagagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311598 - DNA, 1833 bp, Homo sapiens
  misc_feature (39)..(39): n is a, c, g, or t
gaacatcgagctcgcaccctgccatttactccatggccnagtttgcatatcggggagtcctgaatagccctgtgaaggctgttcgtgacacgctcatcacccagtgtgcccagatcctggcctgttacagaaagaactgtgctagcccctcctctgcaggacagttgatccttcctgagtgcatgaagctactcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311599 - DNA, 1775 bp, Homo sapiens
tattgacaaggagttcgtgacatgctcttcaacctgtgtgccctggtgcctgggctgcttacaagactagtaactgctagctaaccgctcctctgtcccggagagtcctaccctagctgagcggctggcgtgcctcccagtttacctgaactgtgtgttgaagagtgatgtcctgcagcctggagctgaagtcactactgatgaccgtgcctatgtccgacagctagttacctccatggatgtgactgagaccaatgtcttcttctaccctcggctcttacctttgacaaagtctcccgttgagagtactaccgaaccaccagcagttcgagcctctgaagagcgtctaagcaatggggatatatatttactggagaatgggctcaacctcttcctctgggtgggagcaagcgtccaacagggtgttgtccagagccttttcagcgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311600 - DNA, 1351 bp, Homo sapiens
ctccataatgtgtgcccatatgtctcctccttcagtcagatcaccagtggtttgagtgttctgccagttctggataatccactgtccaagaaggttcgaggcctcattgatagcttacgggcacagagatcccggtacatgaagcttaccgtggtgaaacaggaagacaagatggagatgctgttcaagcacttcctggtggaagacaagagtctgagtgggggagcatcttatgtggactttctctgtcatatgcacaaggagattcggcagctactgagctaaagcaagtgggtaaatggcatagggcccaggctagcttccagaaagcaccccaggatgtcagagaaattgggacagtaacatatcttatgtaagctgacctcagtctctctggggggagggggagatataaggagacaccttctttctgggctcaagtatcctgccactctgtcatgtcctgctgatggaaggtgcccctgttccctcattctaccctctttttcctgctaatcctgtcataatgaatgtagcttctcagttcactgtatatgattcggtattgggggtttggaggcacccagaccctggcaatattatgtgtccctttggaccagtctcccaagaggagaggggcaggcaggaaagagtggggatcctaaggttactacagggggctcagtgtcatccacaacttcctatattagggataaaacatataggtgcacaagagctggggtatagcccataggtggtggagagaaaagtggtcagtccttcttgggcctggaggttagcagtcaagtttctctgctttcactgctcgctcgctctctcctgcaatgattgatgatcactccgtggatagagaggcacactgtcagaggtgaccggagaactgagttgcaaaatatattaagatctggtagaggtaccagcttcctttccagctggagaggccccaacactggatggttctgtagggagcctagggagcctggtcatcaacttgcaatacctcacagagccagttcacatcccactctgagctcccacgagaaacactgcttctccaggcccggggttgttggggagagaggcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311601 - DNA, 770 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggctgcctgggtctcagccatttgggtccccattggcccctgtgggcaaccagccacctgtgcttcagccctatggccctcccccgacaagtgcacaggtggctacgcagctgtctggaatgcagaggcagctggagcgccgttctctcctgctgggacaccgcttgggctttggtattgactgagtggctgacagttatcttccaaccccaactggcttgggggcaggacaagggctaggcttgatggtggccaggcttgcctgctccccacctgggatgcccctgctctggacctctcatttctcttcattggtttatttttcaatgcatctttaatttgtaaagaaataaaataaattaagatgtaa

SEQ ID NO: 311602 - DNA, 769 bp, Homo sapiens
gaaccggaagtggagcctgggagccttgacgttaggaacgaagtctaacctggatctggagccgggtgagatcaaattgggaatgctttcataatgaacgtcaaccagtcagttccacctgtgccaccatttgggcagccccagcccatctacccagggtatcatcagtccagctatggtgggcaatcagggtccacagcccccgccattccctatggagcctacaatggcccagtaccaggctatcagcaaacacctccccaaggtatgtcaagagccccaccttcctcgggggcacctccagcctcaacagcacaggctccttgtggccaggctgcatatggccagtttggccaaggagatgtacagaatgggccaagctccactgttcagatgcaaaggttacaggtactgctgacgtccagccctgtggattattgacccatcttagtacctgggttcctttgcatattcttcattttctgtgaacttgagtttcttgctttactagacatacatcttcaataatggttgcagtcctgttgagactaccctaagggagaaatgggaagaggaaacttcaggattatttgcatctcttttgacttgcccctttcctctagaacaggcacttagtaggactgattggttaagtttgggcatggccagttatgaactgaaagatactaaaagggaaaccacataaatggtgaaaacttcagtggtacagtgacccaataaacccatcttagcatgaaagtccattaaa

SEQ ID NO: 311603 - DNA, 402 bp, Homo sapiens
cttgtagaaatggttataaacccatatattcaccagttaccccagtaactcctggtacaccaggaaataccatgcactttgaggtgagaaattttaatggagaaaaaaaaattcaacacttggggggatggaatttcttttaagagctctttcccctcctttaacaactagtgtgctgagaatacaaaaaaaaggttgtaagaaactaaaaatcagaaaaattcatttatatgaatttagatgtttttatttttactaaaatgagcataactttcatcttgttgatatacacagtagactaaatgtgtgtatctaattgatcttaaagcagtcttatttggggaatggaaataaacaggaaacaagatctaaaactaaagtctgtatatttttcattttgtt

SEQ ID NO: 311604 - DNA, 1702 bp, Homo sapiens
  misc_feature (1699)..(1699): n is a, c, g, or t
cttgtagaaatggttataaacccatatattcaccagttaccccagtaactcctggtacaccaggaaataccatgcactttgagaatatttcttccccagaaagttctccagaaataaagagacgcacttatagtcaagaggtaagaagttaacttaaaaagggtgaattggtagtttttttcctattacattgttttccttaaattactggtaaattttgaaataaacagtcccaagatgtgattatttgtgtaatttttttttttaatttgtaaacagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggtaagcccattgtgaagtatgctactctggaaaaaacaagcttttgttcaagtattcttcctatttgttgttctcccaaggctaagctgatagtgcttcgtggtcacaattttaaaagattctctctgctaataggattttaagccagctgtgtatggcctgtgttcttaaatgtcgattgtatttattccttggtaatttattcatactttacacacacatatcctctccaaagaatttttatcagattcaacaattctgcagacttcctttataacccctaccagttaccttgaaagaacaaccagggttagtgcttcttcagaaggaataggagcagctgcatataggatggatcttggcaaatggcaggcagccacactcactttgctccttggtcccctttccacctgaaagcatgcaatcctgatagcagtttgttaggggcatgttttggtacctttggtaacctgaagtgacattctcaatgtcaatatattatcttcaactccttgccttcttttcaccaataaattgctggagacaaaggaattgagtccttcaaatanagg

SEQ ID NO: 311605 - DNA, 2409 bp, Homo sapiens
cttgtagaaatggttataaacccatatattcaccagttaccccagtaactcctggtacaccaggaaataccatgcactttgagaatatttcttccccagaaagttctccagaaataaagagacgcacttatagtcaagaggtaagaagttaacttaaaaagggtgaattggtagtttttttcctattacattgttttccttaaattactggtaaattttgaaataaacagtcccaagatgtgattatttgtgtaatttttttttttaatttgtaaacagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttaccc

SEQ ID NO: 311606 - DNA, 1967 bp, Homo sapiens
cttgtagaaatggttataaacccatatattcaccagttaccccagtaactcctggtacaccaggaaataccatgcactttgagaatatttcttccccagaaagttctccagaaataaagagacgcacttatagtcaagaggtaagaagttaacttaaaaagggtgaattggtagtttttttcctattacattgttttccttaaattactggtaaattttgaaataaacagtcccaagatgtgattatttgtgtaatttttttttttaatttgtaaacagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacatatgaagaagggaggtgacagctgaagtcctcatctttaggggggctgccttcaagcaaggttagaagaaggagtggagggttacgatgatgtacaaccattcaggatatgatctggctatg

SEQ ID NO: 311607 - DNA, 1917 bp, Homo sapiens
cttgtagaaatggttataaacccatatattcaccagttaccccagtaactcctggtacaccaggaaataccatgcactttgagaatatttcttccccagaaagttctccagaaataaagagacgcacttatagtcaagaggtaagaagttaacttaaaaagggtgaattggtagtttttttcctattacattgttttccttaaattactggtaaattttgaaataaacagtcccaagatgtgattatttgtgtaatttttttttttaatttgtaaacagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaaggtcagtaagcagatgaccgataatgttattcttaacaaattttaaaatcagacaagagagcctttataaaaagttggtttggatagtagaatgtatgttgctttgtggtgttaaaacaggtgtttattgtgtaattttatacttactataggtttcttctgctttatagaccctgatcctgaaaatccagaacccacaactacgaatgaatgtccatccccagatacttctcaaaatacttgtaaaagtcctccaaaaatgagcaaggtaataacattgacctttcgatgggttccaaaggactttaggttgagtgcagaaaagctgatggttataatatgcagtgtttttctgctgtatcaagtatcaacttgtgacttctggacacttttcctgtcagaaatactcaattgtgtttactactgtttgttcttcttactgaacatgtgatggataactctgaccaaacattcaagttttctaagcacacttcaacagcttacattttcttcaaatgttccacctctattctagtggtgtccaggaaattcatagccttgtcatgaaattct

SEQ ID NO: 311608 - DNA, 1863 bp, Homo sapiens
aactggttgtccaaaaaagaaacttagttccaccttaaatttgggcccctacaatccagcctgagccacagagcgacactttgcctccaaaaaaaaaaaaaaaaaaaatggatatcatcattattttaacatctacaaaaccaacaaaatgtgccctgccaagattaactattttcaaaggttaacaccaaagtattttcccagtagatcaaaagccttggtctgacagtacatgttgactatgaagcaacaatgtaactagcagtagtttctttcaatagaggataatgtgatttttctttgaaaggactgcctcaacttcagtggaacaagtcagagaaaggagttatcagagagctttacttctcagtgatcaccgaaaagataaagatagtggtaagtgagcttgttccttcaccagaaagtggaatcagttaatcactctgcatcctcgttctttgcagctctaatgttctctttgggtctgctctgcttcatctctagggggagaatcaccatgtgtctcatgttcaccgagtcatgttcagtcttcaccttcatctcattcaaatcacataccccagttgcaagctaagggcccagtcccttctttcagtgaacttatggaaggtcagtaagcagatgaccgataatgttattcttaacaaattttaaaatcagacaagagagcctttataaaaagttggtttggatagtagaatgtatgttgctttgtggtgttaaaacaggtgtttattgtgtaattttatacttactataggtttcttctgctttatagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttaccc

SEQ ID NO: 311609 - DNA, 3040 bp, Homo sapiens
cttgtagaaatggttataaacccatatattcaccagttaccccagtaactcctggtacaccaggaaataccatgcactttgagaatatttcttccccagaaagttctccagaaataaagagacgcacttatagtcaagagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacaaaatgaagtaggcatatttaccactcctaattttgatgaaacttccagtgctactacaatcagcacatctgaggatggaagttatggtactgatgtaaccaggtgcatatgtggttttacacatgatgatggatacatgatctgttgtgacaaatgcagcgtttggcaacatattgactgcatggggattgataggcagcatattcctgatacatatctatgtgaacgttgtcagcctaggaatttggataaagagagggcagtgctactacaacgccggaaaagggaaaatatgtcagatggtgataccagtgcaactgagagtggtgatgaggttcctgtggaattatatactgcatttcagcatactccaacatcaattactttaactgcttcaagagtttccaaagttaatgataaaagaaggaaaaaaagcggggagaaagaacaacacatttcaaaatgtaaaaaggcatttcgtgaaggatctaggaagtcatcaagagttaagggttcagctccagagattgatccttcatctgatggttcaaattttggatgggagacaaagatcaaagcatggatggatcgatatgaagaagcaaataacaaccagtatagtgagggtgttcagagggaggcacaaagaatagctctgagattaggcaatggaaatgacaaaaaagagatgaataaatccgatttgaataccaacaatttgctcttcaaacctcctgtagagagccatatacaaaagaataagaaaattcttaaatctgcaaaagatttgcctcctgatgcacttatcattgaatacagagggaagtttatgctgagagaacagtttgaagcaaatgggtatttctttaaaagaccatacccttttgtgttattctactctaaatttcatgggctagaaatgtgtgttgatgcaaggacttttgggaatgaggctcgattcatcaggcggtcttgtacacccaatgcagaggtgaggcatgaaattcaagatggaaccatacatctttatatttattctatacacagtattccaaagggaactgaaattactattgcctttgattttgactatggaaattgtaagtacaaggtggactgtgcatgcctcaaagaaaacccagagtgccctgttctaaaacgtagttctgaatccatggaaaatatcaatagtggttatgagaccagacgg

SEQ ID NO: 311610 - DNA, 2378 bp, Homo sapiens
cttgtagaaatggttataaacccatatattcaccagttaccccagtaactcctggtacaccaggaaataccatgcactttgagaatatttcttccccagaaagttctccagaaataaagagacgcacttatagtcaagaggtaagaagttaacttaaaaagggtgaattggtagtttttttcctattacattgttttccttaaattactggtaaattttgaaataaacagtcccaagatgtgattatttgtgtaatttttttttttaatttgtaaacagggatatgacagatcttcaaccatgttaacattggggccttttagaaattctaatttaactgaactgggtctgcaagaaataaagactattggttatacgagccctaggagtaggactgaagtcaacaggcagtgtcctggagaaaaggaacctgtgtcagaccttcagctaggactcgatgcagttgagccaactgccctacataaaaccctggaaacgcctgcacatgacagggctgagcccaacagccaactggactcgactcactctggacggggcacaatgtattcttcctgggtaaagagccctgacagaacaggagttaacttctcagtgaactccaacttgagggacctgacaccctcgcatcagttggaggttggaggaggcttccgaataagtgagtcaaagtgcctgatgcaggatgatactagaggcatgtttatggaaacaactgtgttttgtacttccgaagatgggcttgtatctggtttcggacggactgttaatgacaatttgatcgacgggaattgcacaccccagaatccaccacaaaagaaaaaggtttctctattagaataccgtaagagacaacgtgaagctaggaaaagtggctctaagacagagaactttccactcattagtgtatcaccccatgcaagtggaagcttgagcaacaatggtgatggctgtgccagcagtaatgacaatggggagcaggtggaccacactgctagcctacctttaccaacaccagctacagtttataatgccacttctgaagaaactagcaataactgccctgttaaggatgctactgctagtgagaagaatgaaccagaagttcaatggactgcctcaacttcagtggaacaagtcagagaaaggagttatcagagagctttacttctcagtgatcaccgaaaagataaagatagtgggggagaatcaccatgtgtctcatgttcaccgagtcatgttcagtcttcaccttcatctcattcaaatcacataccccagttgcaagctaagggcccagtcccttctttcagtgaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccatcttcgtcttactatcaaaaccagcagccctctgcaaactttcagaattataatcagctcaaaggtagtctttctcagcaaactgtgttttcatcatccccaac

SEQ ID NO: 311611 - DNA, 1848 bp, Homo sapiens
gcctggctaatttttttttgtatttttagtagagacggggtttcaccatgctggccaggctggtctcagactcctgaccttgtaatctgcccaccttggcctcccaaagtgctgggattacaggcgtgagccactgtgccctgccaagattaactattttcaaaggttaacaccaaagtattttcccagtagatcaaaagccttggtctgacagtacatgttgactatgaagcaacaatgtaactagcagtagtttctttcaatagaggataatgtgatttttctttgaaaggactgcctcaacttcagtggaacaagtcagagaaaggagttatcagagagctttacttctcagtgatcaccgaaaagataaagatagtggtaagtgagcttgttccttcaccagaaagtggaatcagttaatcactctgcatcctcgttctttgcagctctaatgttctctttgggtctgctctgcttcatctctagggggagaatcaccatgtgtctcatgttcaccgagtcatgttcagtcttcaccttcatctcattcaaatcacataccccagttgcaagctaagggcccagtcccttctttcagtgaacttatggaaggtcagtaagcagatgaccgataatgttattcttaacaaattttaaaatcagacaagagagcctttataaaaagttggtttggatagtagaatgtatgttgctttgtggtgttaaaacaggtgtttattgtgtaattttatacttactataggtttcttctgctttatagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttaccc

SEQ ID NO: 311612 - DNA, 1366 bp, Homo sapiens
  misc_feature (135)..(135): n is a, c, g, or t
aaaaagaaaaaaaaaattgcttttgttcctctgtgtacccaactgtcttcctccactcctgtttgtccatccttgggccgaatctgtccatccatgcactctttttgctcctctatatggctatctgtgggtgcncctgactatctctgcccctcttctgcccctctctctgtctgtcctaggcagtccatctgtccatccctacaccctgccccttctgtcctctgcgtacctctctgtctgcttggaaccctccacccccttaatctccacatcctccatggtgctgaaacttatggaagaccctgatcctgaaaatccagaacccacaactacgaatgaatgtccatccccagatacttctcaaaatacttgtaaaagtcctccaaaaatgagcaagcctggttcacctggatctgtaattcctgctcaagcacacgggaaaatattcacaaaaccagatccccaatgggactccacagttagtgcatccgaagctgaaaatggtgttcacctaaaaacagagctccaacaaaaacagctatcaaataacaaccaagcactttcaaagaatcatcctcctcagacacacgttcgtaattcatctgagcaactttcacaaaagctgccttctgtgccaacaaagttgcactgtcctccatcacctcacctagaaaatcctccaaagtcatccacgcctcacacacctgtacagcatggttatctttcaccaaagcctccttcacagcagttaggatctccctacaggcctcatcattcacagtcacctcaagttggaacacctcagcgagagcctcaaagaaacttttatccagcagcacagaaccttccagccaatactcagcaggcaacttctggaacattatttacacagacaccctcaggacaatcttcagcaacatacagtcagtttaaccaacaaagtctgaacagcacggcaccaccccctccacctcctccacctccttcttcgtcttactatcaaaaccagcagccctctgcaaactttcagaattataatcagctcaaaggtagtctttctcaacaaactgtgtttacatcaggaccaaatcaagcacttcctggcaccacaagccagcaaacagttccaggacaccacgtgactccagggcattttttgccctctcagaaccctaccattcaccatcaaactgctgctgccgtagtcccccctcctcctccaccaccacctgctccaggaccgcaccttgtacaacagccgaattcccatcagcaacactctgtagcacatgtagtagggcctgttcatgcggtcacccctgggtcgcatattcattctcaaactgctggacaccacttaccc

SEQ ID NO: 311613 - DNA, 406 bp, Homo sapiens
tttacctccatcaccaaaatgtccacgagtttgaaagtgacctcacgataaccattttttaagactacttggagttttgcaaacaagatgttaggaagattcatttaagactggaattcatgctttcttccttctctggtggttttaagaatgtgtttgtaatctcctatagaaacttgtcattgtaaaataattcctgcttcaaagaaaatattttacaaataggatatcattcttattatattgtgaggtaagcatctgattatttcttttgtaggaaatataatttccccatttgaaataatttctgcaatggatctaaaataaatggaaatatttttccctcatttctaaacactcttatcgatactctgagtagcttaagtaaaaaagaaaaaaattaaag

SEQ ID NO: 311614 - DNA, 1809 bp, Homo sapiens
cagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgactcggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtaagcttgggccatcggtccccactgttggttttcattccttatctgggctgttgtgtggttaattgattgatcattttgaaagctagcacttgactcacactcggaatcccagaactttgggaggtcaaggcaggaagatcacttgagcccaggagttcaagaccagcctggacaatatagtgagacccccatctctacaaaaa

SEQ ID NO: 311615 - DNA, 457 bp, Homo sapiens
aatcatgtcctcctggatctaatggccttgcccttgtccttcagcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtaagcttgggccatcggtccccactgttggttttcattccttatctgggctgttgtgtggttaattgattgatcattttgaaagctagcacttgactcacactcggaatcccagaactttgggaggtcaaggcaggaagatcacttgagcccaggagttcaagaccagcctggacaatatagtgagacccccatctctacaaaaa

SEQ ID NO: 311616 - DNA, 5878 bp, Homo sapiens
cagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgactcggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttcccctttatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaggtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcagccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtctcggaccccgcggctggcagccaagggcctctgtccactaccctgaccttctccagccccgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaa

SEQ ID NO: 311617 - DNA, 3464 bp, Homo sapiens
aagttagtcgggaccgtggactcgagggcggacacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcagccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtctcggaccccgcggctggcagccaagggcctctgtccactaccctgaccttctccagccccgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaa

SEQ ID NO: 311618 - DNA, 5825 bp, Homo sapiens
cagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgactcggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttcccctttatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaggtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcagccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtctcggaccccgcggctggcagccaagggcctctgtccactaccctgaccttctccagccccgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaa

SEQ ID NO: 311619 - DNA, 1915 bp, Homo sapiens
acatcccacgtgtgatccctttcactccatcaggacccaggactgtccttaggaaaatgtccttgagatgcagcaggagtcatattctctgtccactaccctgaccttctccagccccgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaa

SEQ ID NO: 311620 - DNA, 1633 bp, Homo sapiens
agcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaa

SEQ ID NO: 311621 - DNA, 5898 bp, Homo sapiens
cagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgactcggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttcccctttatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaggtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcagccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtctcggaccccgcggctggcagccaagggcctctgtccactaccctgaccttctccagccccgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaaaaaaaaaaacgcaaaaaaca

SEQ ID NO: 311622 - DNA, 5967 bp, Homo sapiens
  misc_feature (5879)..(5879): n is a, c, g, or t
cagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgactcggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttcccctttatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaggtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcagccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtctcggaccccgcggctggcagccaagggcctctgtccactaccctgaccttctccagccccgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaanaaaaaaaaacccggcttattcgtggggaaaggttaggctgcactgtccgccctttgaaggggaccggccaggagtataacgcggaaga

SEQ ID NO: 311623 - DNA, 4173 bp, Homo sapiens
cagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgactcggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttcccctttatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaggtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcagccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtctcggaccccgcggctggcagccaagggcctctgtccactaccctgaccttctccacacttcctggattcctaccaggtcatgttcttcacgctcttcgccctgttggctgggacagcggtcatgatcataggtgaggaggctgcctgtatct

SEQ ID NO: 311624 - DNA, 1792 bp, Homo sapiens
cagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgactcggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtaagcttgggccatcggtccccactgttggttttcattccttatctgggctgttgtgtggttaattgattgatcattttgaaagctagcacttgactcacactcggaatcccagaactttgggaggtcaagtacaagttgtgcaaagtgagaaagatctttgtgggcccaaagggaatccctcatctg

SEQ ID NO: 311625 - DNA, 438 bp, Homo sapiens
gggaaataatagtgtgatgaacatctgtctgtacattgacatgtttctctccattgtgttgttaggttaggttccagatggggaattcctgggttccagggctgtgggtattttcaaggcttttaccagattgtttgacgaaagaggcaaatccatgtacaccctccagcagtctgtcagagtgagggcttaattctatctacaccccattcctctggatctttgcaatgatccctgtgagtgctgcagatgacgagaatgagtttcaaacaggagatggggcttgcctgaccaccagcccccacaagcggggtgaggatgtggggctgggatgcccggctcctgcccgtgctgccttagaagaatgccaagtcttctgcctcttctgtccccaggctgtggatccctcctctgttgccttggtaaccctgggctcct

SEQ ID NO: 311626 - DNA, 692 bp, Homo sapiens
atgggtgaacccatgagtgtgaggataaatgtgtatgagtgtgagtacgtgcatgcacacgcacgtgtctctgaccctctgacttccccagcaggctaagggtgggtggctggtcctgtgatggcttttcctccgcaggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgagatctcagggccaagacaccccctgggaggctcggatggtggtctccagccgccccctctgagcaagcctcgacttcactcagaaacacccccaaccttgggtcctgtacttaggagctcaagccccagcccttcccttaggagctcacggccatgtcaggaagatggacaggatgtctcacaccagccaacaatgggcccagaaaggccagtgtccacagagctgggtttctggaggggagataatctaagagccattctagaaaattccccagacctgaaagatagtaatctccatttggaaggtccaccaagcactgggttgtaaactcacagtgaaagggcaccaccaggctccgagagaccaggccagactcctctctcttcactcacc

SEQ ID NO: 311627 - DNA, 401 bp, Homo sapiens
taccaagaacagctgtgggcccgggcctccagcaggtggcctggccctctgagaccaccatccttacatctaagagggacctgtggactgccctgtagacgtacagtagggcaggaacgtgatgggatgccacagtgggcctggtggttttggtaactcatcttcccattgatggcagatggagccagcctcttccagcacttcctggattcctaccaggtcatgttcttcacgctcttcgccctgttggctgggacagcggtcatgatcataggtgaggaggctgcctgtatctctgggtctgttcccctgccccgacctgctctaaccaaccctgtgctcttgcagcctaccacactgtctgcacgccccgggatcttgctgtgcctgcagccctcacg

SEQ ID NO: 311628 - DNA, 404 bp, Homo sapiens
tgcggccgccaactgggagcatgatgatctgaatggcactgcgtgggctgtggatgctggtatgggttccaaaaatgagggtggccagctggtcatcctcgataacagatattcagacttcatgaccatggcttaccccacaccgctcccatgacagtaagcagagtctaaggctgggcctgtctgtcactgatatgctgactctccctagattatatggggatggtgtgggcctggtgtagcggggttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaa

SEQ ID NO: 311629 - DNA, 3493 bp, Homo sapiens
ttatgctatcgtcgaccagcgctcgccacgcgtcgaggtcctggaccttcgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcagccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtctcggaccccgcggctggcagccaagggcctctgtccactaccctgaccttctccagccccgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaa

SEQ ID NO: 311630 - DNA, 3289 bp, Homo sapiens
aagttagtcgggaccgtggactcgagggcggacacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcagccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtctcggaccccgcggctggcagccaagggcctctgtccactaccctgaccttctccagccccgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaa

SEQ ID NO: 311631 - DNA, 2012 bp, Homo sapiens
ccatgcttgacgtagatcaagaggatcccacggggatatgtgccccggaggttctggagaacttggaggtgaaatccgggtccccggccgtgctggcattcgcaaaggagaagtcttttgggtggcccagcttcatcacatacacggtcggcgtctcggaccccgcggctggcagccaagggcctctgtccactaccctgaccttctccagccccgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaa

SEQ ID NO: 311632 - DNA, 1969 bp, Homo sapiens
cccccagctctgatgtctcttccaggtgaaatccgggtccccggccgtgctggcattcgcaaaggagaagtcttttgggtggcccagcttcatcacatacacggtcggcgtctcggaccccgcggctggcagccaagggcctctgtccactaccctgaccttctccagccccgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaa

SEQ ID NO: 311633 - DNA, 2075 bp, Homo sapiens
gggaggccacgggtgctcgggctcctcgcggctctgctgccttctgcagctgctctggcagcaggtgcctgccctttctagctgcctctctcagcgtgctcctccctgggttttgggagccacacctggatctctgcaaggtctccggagcactgcagaatcgctgctcccctcggggtctttgttcctgtggcgctcttgcccgaggctgcattgcattcagatgcacggggcctccctgcctcatgccccctggacagatgctgctgtggtcctgaaacttgagacacgttctccccggaaggctctgcgctcctgggtgttagggtggcatcccaggcctctctgtgtgaatgaggccagctcagaaggtgcccgtggacttccctctgctggccggggaggcctcggggcatcactgtgagagtgtcctgggtgaggcaggcgcctgctgaatgctggctgtaactgaagagtgcgccgctttccctggctctgctgctaacatcgtctctcttcccaccctagatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgattttttaa

SEQ ID NO: 311634 - DNA, 4517 bp, Homo sapiens
cagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgactcggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtgcaccctttgctcccgggctcatccaccatcatgatccatgacttgtgcctcgtcttcccggccccagccaaggctgtcgtttacgtgtcggacattcaggagctgtacatccgtgtggttgacaaggtggagattgggaagacagtgaaggcatacgtccgcgtgctggacttgcacaagaagcccttccttgccaaatacttcccctttatggacctgaagctccgagcagcctccccgatcattacattggtggcccttgatgaagcccttgacaactacaccatcacattcctcatccgcggtgtggccatcggccagaccagtctaactgcaagtgtgaccaataaagctggacagagaatcaactcagccccacaacagattgaagtctttcccccgttcaggctgatgcccaggaaggtgacactgcttatcggggccacgatgcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggacctcgtgcaggtggaggtgctgctgctaagggccgtgaggatccgcgcccccatcatgcggatgaggacgggcacccagatgcccatctatgtcaccggcatcaccaaccaccagaaccctttctcctttggcaatgccgtgccaggcctgaccttccactggtctgtcaccaagcgggacgtcctggacctccgagggcggcaccacgaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtgtttgagaagctgcagctgctcaaccctgaaatagaagcagaacaaatattaatgtcgcccaactcatatataaagctgcagacaaacagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggcctctcaggaacctggagctcctcagccaacagcatcctccacatcgaccccaagacgggtgtggctgtggcccgggccgtgggatccgtgacggtttactatgaggtcgctgggcacctgaggacctacaaggaggtggtggtcagcgtccctcagaggatcatggcccgtcacctccaccccatccagaccagcttccaggaggctacagcctccaaagtgattgttgccgtgggagacagaagctctaacctgagaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgaaatccgggtccccggccgtgctggcattcgcaaaggagaagtcttttgggtggcccagcttcatcacatacacggtcggcgtctcggaccccgcggctggcagccaagggcctctgtccactaccctgaccttctccagccccgtgaccaaccaagccattgccatcccagtgacagtggcttttgtgatggatcgccgtgggcccggtccttatggagccagcctcttccagcacttcctggattcctaccaggtcatgttcttcacgctcttcgccctgttggctgggacagcggtcatgatcatagcctaccacactgtctgcacgccccgggatcttgctgtgcctgcagccctcacgcctcgagccagccctggacacagcccccactatttcgctgcctcatcacccacatctcccaatgcattgcctcctgctcgcaaagccagccctccctcagggctgtggagcccagcctatgcctcccactaggttttccgcgcccactaggttttccgcgcccactaggttttccgcgcccactaggttttccgcgcccactaggttttccgcgccc

SEQ ID NO: 311635 - DNA, 1769 bp, Homo sapiens
cagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgactcggctgtcgaggtggagaaccagggtgtgttccagccactcccagggaggctgccgccaggctctgagcactgcagcggcgtccgggtaaaggccgaggcccagggctctaccacgcttcttgtgagctacagacacggccacgtccacctgagtgccaagatcaccattgctgcctacctgcccctcaaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtcccagtgtccagccaccgcaaccccctgctggacctggctgcttacgaccaggagggccgccggttcgacaacttcagctctctgagcatccagtgggagtccaccaggccagtgttggccagcatcgagcctgagctgcccatgcagctggtttgcaggccattttggttcacgaggcatcaggaaccacagccatcactgccactgccactggctaccaggagtcccacctcagctctgccagaacaaagcagccgcatgaccctctggtgcctctgtcggcctccatagagctcatcctggtggaggacgtgagggtgagcccagaagaggtgaccatctacaaccaccctggcatccaggcagagctccgcatcagggaaggctcaggttacttcttcctcaacaccagcaccgcagatgttgtcaaggtggcctaccaggaggccaggggtgtcgccatggtaagcttgggccatcggtccccactgttggttttcattccttatctgggctgttgtgtggttaattgattgatcattttgaaagctagcacttgactcacactcggaatcccagaactttgggaggtcaaggcaggaagatcacttgagcccaggagttcaagaccagcctggacaatatagtgagacccccatctctacaaaaa

SEQ ID NO: 311636 - DNA, 403 bp, Homo sapiens
  misc_feature (375)..(375): n is a, c, g, or t
cagggcactaaagaggggacagacggccattgacgcggccctcacctctgtggtggaccaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgtatgtgatcgtggggtngtaagtgatcgtgggagtaaggtccgag

SEQ ID NO: 311637 - DNA, 467 bp, Homo sapiens
gagctgatggctccaggtggctggagtcaggagcatgaccggcactggggcaggcagcgtggctgtctcctgaggctgctgagtgagcccccatgggggtagcggcagccagcgaggaagctggcctgtcatccaggtgagctgggctttgactggagtgtccagctatggaaagggggctgacacctgtgcttcctctccaggcctctcaggaacctggagctcctcagccaacagcatcctccacatcgaccccaagacgggtgtggctgtggcccgggccgtgggatccgtgacggtttactatgaggtcgctgggcacctgaggacctacaaggaggtgggctctaagcagccggaggcacatgtggctcagtggcctgtgaggcgggcctgaccttctgggaggattatgaagacttttccttttagggaaaagccgtctgaggggttgggtctgggagtca

SEQ ID NO: 311638 - DNA, 1276 bp, Homo sapiens
ttctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatggctctctgctgccagcgactgctgtcaacgtggtggaaaccagtggaacacaagggccttgcccccaccccagaccgcacatagaaactacactgactttgttcatgagcacaatgtgaagaatgcaggaatccgtcatgatgttcattttcctggccatacagccatgactgagatatgagtgttgagcctcttaggctttgggactctttgtcatgcaagttgatggtatacattatctggtgtttataaaggattaatcacattaggagtatttgggagaatttacagtgagtcactagttgttcagtgctgtttgtaattgaattcttccatgaaagggacaaggaatcaaggaagccatatagcatcaatgataatgacaaatgtttgtgttgaaaagagtgtgtataccattgtggttttggaagagttttcagaccttagtatgttcacacatcaccagactgtatctcaggagaaggtttgtgtttgtgaacaaggtgcccattattcccccaccacatgccatccaaagagatcgaggttaaaagaatcagacacactaaaaacacagtggaagcatgtctaggcataatatatcagccttttgagatatttattaaaaacttgttcttatacactattttaatatgtctaaagtgacacataccttaatttaagtgcctaagattttaattaatataatttttaattacaaacacttttactttttaataaacacgaatattttaacttaccaaaagatttagagatcacattaataatgtggctcatgtatagagaaatctgaatgtttagttttgaatggttaactgattaacattcagttatcataacagttaaccagtggttaactgaatggttacattactactgaatggttctataaaatgaaaaacatatttactttgtcttttcatttgactggcttttctctttcatctcatacacctgacagattacccaggtttgcaacagtctcataatctgatcctgtataacctttaaaataaaattctgaagccaaaaccaaaaaaaa

SEQ ID NO: 311639 - DNA, 532 bp, Homo sapiens
ggctgtcagaggtccctgcaagacgtatcagaacttaggtgcacaataatgtttcgagccaaagtaagggctcccaacaggcttgggggatgagatctgctctgcctgtgagtccttccatttcctctgctcctgtgccagtggagatagagaatcttccacagagtcctggaacagaccagcatgacaggaaatgcattcctctgaatattgatttgctgaatagcccagacttattggaaacaacgattggtgatgtaattggggcatctgacactatggaaacatcccaagcactgaatgacgttaatgtagccaccaggcttccgggattaggggaacctgaagttgaatatgagagtaagtaaatgttccattatacatcagtgatacctttttatcttcctttgaaataagatatttaaatattttctattatagcaaataaagggaactaaactgtaatgacacacgtgttcttgtgaacatggcacactggttctgaaggtaaaagacgagtacttattctgag

SEQ ID NO: 311640 - DNA, 507 bp, Homo sapiens
tctgtcatccaggctggagtacggtggtgtaatcttggctcactgcagcctctgtctcctgggctcaagtgatcttcccacctcagcctcctgagtagctgggactacagctgagtgctactgtgcccagcttagctcagtttttgtaaagatgaggtctcactatattgcccaggctggtctcaaactcctgggctcaagggatcctcccgccttggcctctcagagcgctaggattacaggtgtgagccactgcatccagccaaaataatttttttgtaattaaaaagaaaaagttaagagccagaatagtcataaccctacccaagttttgtcttaccaaaggagaatagctatttgaaaatttacatagcacttcagctttttcacatcctgattgtagtataggtttccctccatgcagaagtggaatcattaacaaccatgatttatgagtgtccctgtgtatttaaaggattaacactaatcaggcctgtgtcagaatta

SEQ ID NO: 311641 - DNA, 6630 bp, Homo sapiens
  misc_feature (4813)..(4813): n is a, c, g, or t
cgtttaagagcggagcgctccgccctgggggcggagctgggagggagctttaaggggcggacgggcgggaggtcggggtcctccggggattagagccggtgggctcgttgtgggcgccatttctcggcgtctcccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatgcattcctctgaatattgatttgctgaatagcccagacttattggaaacaacgattggtgatgtaattggggcatctgacactatggaaacatcccaagcactgaatgacgttaatgtagccaccaggcttccgggattaggggaacctgaagttgaatatgagacattaaaagacacctcagagaagctcaaacagcttgagatggagaacagtcctttgctgtcccctcgatccaacatcgatgttaacataaacagccaggaggaagtggtgaagttgactgagaaatgccttaataatgtcattgagagcccaggattgaatgtcatgagagttcctcctgacttcaagagtaacattttgaaggctcaagtagaagcagtgcataaggttacaaaagaagatagcttattaagtcataaaaatgccaatgttcaggatgctgccacaaacagtgctgtgttaaatgagaataatgtgcccctccccaaagagtctcttgagactctgatgcttatcacacctgccgacagtggttctgttctaaaggaagctacagatgaattggatgccttgcttgcatctctaactgagaatctaattgatcacacagttgcacctcaggtgtcttccacatccatgatcacaccccggtggattgttccgagtggtgccatgtctaatggacttgcgggatgtgaaatgcttttgacagggaaggagggacatggtaataaagatggaatctcactgatctctcccccagcgccattcttggtagatgctgtgaccagctctggtcccattttggcagaagaagctgtcctgaagcagaagtgtttactgaccactgagctctgagggcctgtagctggaatacgcatctctccagcattccgtcctgggatccgtttcagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggctccacctagcggttctatttgttcataacaacttcataacaagcctgcctctggtagtcaacagccttttgaaagctatttccatctagtatcagggtgagagcatccttgatctggctgcctgttagagaaattgcacttttcctgacttacctagaaatcaagaatttaggaaattaatgtggacactataaaggcagacttagggccaacttttttttttttttacaattattacaacactaaagagaagtttagaatatagagagtttttaaatgtctcccattcttttgatttcttactgtactggctatcttaatatttcaagtttacatcaagataaaccctgagaagaactacggagaaatcaaataaaatcctgtcatatttttttcaccctgcctttccacaggaagcactcacaggcaccacacacgtatcatgtaacttatcagtggggtgggttactgttgaagagaccctggggcatttacctcaggcatctgcactcctccgagcccggtggagaatgcaggctgctgtagtctcaggtaatgaaggcacagcacagcagtactccacattgtttcctatttggacatagacttcatttcctttcagtataagctgaataaatttagagctttcaaactggaaaaaaaaatgaaacaaaacaaatacaccaagaccaaaataggcaataggaacaggggtgaagggatgttgtttcttaaatacctaccatgtatgaagctatacacagcatataccgaaagaacctgcattgcactaggaattctgtgttagtttaaaagagatctctaaaacttccccatccctttgggcctgtacaaagaaattctggatgttaaaataatatatactcatcacagaaaaataaagtatagcaatgtccatctgtaattctaatacccagaaataacgctatttagctttataattttcgaatgaacaaggtaaacctcggttgccatggggaagaaggatgatgtggaaaccatattggtaaagttgttaatccctcgttatggagaactgatcttaagctatacctcctggaatttgctttctagttttctgtcctgcaatatgtatataattaagcactaatttgtactgcttagcataaaagaacatccagtcttagatccttaaaacttcatggattggactttcctgggctccttataacataatcgtgtgtccaggcaaacgcacactagtgtctgactggaaagctcaggaattttaatcttgcactgtttcccagggagctgtagtgattggaacccacgtttgcacaaaacatttttgcagaaggaaagtcaacacttcttgctggctgcctccccttagccattatgctaaaaacagcttctgagtttcactggtggggctcttgccagttcttaattataggacatattttctcaaagctgaaggtgacacctagaaccaggggcttgacccaggacatgatggaatgagcatcaaattttcagtgtcttggcaaccgtagatgtcctacagggttaccgttgtgctgctcaccacagagcagctgaggcattatgccttggaagacctaaatctcccatccagttcaggaggtgacaacatccttattttaaacttcctaaaattaggaattaggtagttggacatagtctgtgacctttatgtcgttggatacctgtattcttgacagttagaatattggtagggactttgttaaaattcacttgaatttcaagctcagaggaaactttgtctcatgccctgacatgaagtggcaaacacggaagttcatacttgaatgctgaattggccccgacagattaaatgcgtgttggggattggtttcctgtcatagctgctgctgctgccatgcgcagagctgctgtaacagctcttcctgttctgctcccctgagaacagtgtggtggggagaggcagggctgaggtggtctacgaatgtggcaggtagggaaggggagatgtctgtctcttgagaagagagaggcatgtgtgccggcatccttgatgggttcaaagagaaaggttggagatgatantgggtgagaagcaggctggtgagactgggctgaggttggagaaggggcagccgggggcactgctgagggtttgccgtgcacgcctcggacggagcacggtggggtggcggggagcagatagtgctgcctccctgcgggcagacaggagaggaacctcaactcagtccatttcatagccctgataggggaagtgggagttgacaggatggtttaaaataagacgtgaaggtttcagttacctgctctagactttgcctgagaacttgtaaattaatcagtgagacctaatttgtgacatgtcagtagcatcatcttttgacacacaggaggtcatggtcatttcattcctactcttcaggagacactgctgaacagaggaatgattctgttccttgtgtgcttacttccttaacatttatacattgttttaagaaaaaacttttaaaaatatttcttatagtctcctaacatttgtctctagcctttgcctttgtacaatcacagatatcctatggagatttaaggatgaaagccctgagttgttcttgggttcttggatctggactacttgttatcttatgcttctcacttctggctaaaacttgcacctcttcttctcttagctaagccccaaaatgaagatttccttcagaagtcttgttagcagaattatttatcagtcacagagagaaaaatctgctatttttctaagtaagagtctcgagaagcagagtttttgtcttgtcattgagaggagtcagcagtcttgttctgtaaaggaccagagatggtaaatactgtcccactcagctctgctggcgcagtacagcagcagcagccccagcacagctgtgttcctgcggagtcccctttacaaagccgctgacccctgatgtgaaactttgtagagcagcagagtggctgcgtgaaacgggaggctggcaggtcctcagataggttctgcagtgttacctgtcacttggaggcagccaacacttctggacattgcatccttattcacacatgtggcagctgaacgaggtgctgttgtgggtgtctcagctctgagggtctttgtgagctcccactgttgtgggtgtctcagctctgagggtctttgtgagctcccactgttgtgggtgtctcagctctgagggtctttgtgagttcccaccaacttttaattattcatgcccttgaccatgtggttgcttggagacctggggtcttctgcagactgaagaagacacatttctagattatttgtcctttttatcctctcaaaaatttaaacactgtacctcttcagtggtcagaagaaagttggaaacttttcctacatattaggcgttagtatgaggacatttgtttgaattatagaaatttgccctgagctgaactgggttgtgttaacacattggtagagctatgattccttcccagttctaagagatacgatctgtaagtccctatgtcaccacattgcttgagatgatcattcagttacttgtcaggatttctcctcttcagagagatttttttttatagcacagattcctttgccccttttatctccttatctggatatgataagtggttatgagggtctcactaactattttgtgtttaccttttatatgtgtaaaactttgcagtagcatttaaagtgtaatttatttttctatcaagtgcactattcatttagtgtgttccagttttatatgacttgtattagaaacactgcactgagttgtttgtacactgaaatgagaactctagatgtaactctattcaaataaaccttcgtgagacattca

SEQ ID NO: 311642 - DNA, 7101 bp, Homo sapiens
  misc_feature (5284)..(5284): n is a, c, g, or t
cgtttaagagcggagcgctccgccctgggggcggagctgggagggagctttaaggggcggacgggcgggaggtcggggtcctccggggattagagccggtgggctcgttgtgggcgccatttctcggcgtctcccgaggagccgcccctttctcagccttgctcggctcttccccgctctggtcgccggggctgcgccgtccccagctcaggtaagcgcgaggcccggcggcggcgccgcagtacagtccgctgcgctcctagccgagtggacccttcctcgcccgcgcctgcggtagcggccttgtccccggggaggcgggcgggggccgcacccagaccctagggcggccggcccctctctcgtcgggccggcagggcattaatcccgccggagggaggggcggcggcggccaatgaggcagggccgccgagtttcggtcgataccgcgcgacgggccggggcggagggcccggggcagccgggttaatgtttgccgagcggacgcgctccccgagccgcgggtacccctcgctggtccgctgggctgccgtccagcgggagagacaaaagtcgcaagggaaggggaaaaacgaactgagtttgtgtcactgtcttggtggacttttcgagctaacctgtatttgagaaaaacttcagtctcttgggaaaggagaggcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatgcattcctctgaatattgatttgctgaatagcccagacttattggaaacaacgattggtgatgtaattggggcatctgacactatggaaacatcccaagcactgaatgacgttaatgtagccaccaggcttccgggattaggggaacctgaagttgaatatgagacattaaaagacacctcagagaagctcaaacagcttgagatggagaacagtcctttgctgtcccctcgatccaacatcgatgttaacataaacagccaggaggaagtggtgaagttgactgagaaatgccttaataatgtcattgagagcccaggattgaatgtcatgagagttcctcctgacttcaagagtaacattttgaaggctcaagtagaagcagtgcataaggttacaaaagaagatagcttattaagtcataaaaatgccaatgttcaggatgctgccacaaacagtgctgtgttaaatgagaataatgtgcccctccccaaagagtctcttgagactctgatgcttatcacacctgccgacagtggttctgttctaaaggaagctacagatgaattggatgccttgcttgcatctctaactgagaatctaattgatcacacagttgcacctcaggtgtcttccacatccatgatcacaccccggtggattgttccgagtggtgccatgtctaatggacttgcgggatgtgaaatgcttttgacagggaaggagggacatggtaataaagatggaatctcactgatctctcccccagcgccattcttggtagatgctgtgaccagctctggtcccattttggcagaagaagctgtcctgaagcagaagtgtttactgaccactgagctctgagggcctgtagctggaatacgcatctctccagcattccgtcctgggatccgtttcagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggctccacctagcggttctatttgttcataacaacttcataacaagcctgcctctggtagtcaacagccttttgaaagctatttccatctagtatcagggtgagagcatccttgatctggctgcctgttagagaaattgcacttttcctgacttacctagaaatcaagaatttaggaaattaatgtggacactataaaggcagacttagggccaacttttttttttttttacaattattacaacactaaagagaagtttagaatatagagagtttttaaatgtctcccattcttttgatttcttactgtactggctatcttaatatttcaagtttacatcaagataaaccctgagaagaactacggagaaatcaaataaaatcctgtcatatttttttcaccctgcctttccacaggaagcactcacaggcaccacacacgtatcatgtaacttatcagtggggtgggttactgttgaagagaccctggggcatttacctcaggcatctgcactcctccgagcccggtggagaatgcaggctgctgtagtctcaggtaatgaaggcacagcacagcagtactccacattgtttcctatttggacatagacttcatttcctttcagtataagctgaataaatttagagctttcaaactggaaaaaaaaatgaaacaaaacaaatacaccaagaccaaaataggcaataggaacaggggtgaagggatgttgtttcttaaatacctaccatgtatgaagctatacacagcatataccgaaagaacctgcattgcactaggaattctgtgttagtttaaaagagatctctaaaacttccccatccctttgggcctgtacaaagaaattctggatgttaaaataatatatactcatcacagaaaaataaagtatagcaatgtccatctgtaattctaatacccagaaataacgctatttagctttataattttcgaatgaacaaggtaaacctcggttgccatggggaagaaggatgatgtggaaaccatattggtaaagttgttaatccctcgttatggagaactgatcttaagctatacctcctggaatttgctttctagttttctgtcctgcaatatgtatataattaagcactaatttgtactgcttagcataaaagaacatccagtcttagatccttaaaacttcatggattggactttcctgggctccttataacataatcgtgtgtccaggcaaacgcacactagtgtctgactggaaagctcaggaattttaatcttgcactgtttcccagggagctgtagtgattggaacccacgtttgcacaaaacatttttgcagaaggaaagtcaacacttcttgctggctgcctccccttagccattatgctaaaaacagcttctgagtttcactggtggggctcttgccagttcttaattataggacatattttctcaaagctgaaggtgacacctagaaccaggggcttgacccaggacatgatggaatgagcatcaaattttcagtgtcttggcaaccgtagatgtcctacagggttaccgttgtgctgctcaccacagagcagctgaggcattatgccttggaagacctaaatctcccatccagttcaggaggtgacaacatccttattttaaacttcctaaaattaggaattaggtagttggacatagtctgtgacctttatgtcgttggatacctgtattcttgacagttagaatattggtagggactttgttaaaattcacttgaatttcaagctcagaggaaactttgtctcatgccctgacatgaagtggcaaacacggaagttcatacttgaatgctgaattggccccgacagattaaatgcgtgttggggattggtttcctgtcatagctgctgctgctgccatgcgcagagctgctgtaacagctcttcctgttctgctcccctgagaacagtgtggtggggagaggcagggctgaggtggtctacgaatgtggcaggtagggaaggggagatgtctgtctcttgagaagagagaggcatgtgtgccggcatccttgatgggttcaaagagaaaggttggagatgatantgggtgagaagcaggctggtgagactgggctgaggttggagaaggggcagccgggggcactgctgagggtttgccgtgcacgcctcggacggagcacggtggggtggcggggagcagatagtgctgcctccctgcgggcagacaggagaggaacctcaactcagtccatttcatagccctgataggggaagtgggagttgacaggatggtttaaaataagacgtgaaggtttcagttacctgctctagactttgcctgagaacttgtaaattaatcagtgagacctaatttgtgacatgtcagtagcatcatcttttgacacacaggaggtcatggtcatttcattcctactcttcaggagacactgctgaacagaggaatgattctgttccttgtgtgcttacttccttaacatttatacattgttttaagaaaaaacttttaaaaatatttcttatagtctcctaacatttgtctctagcctttgcctttgtacaatcacagatatcctatggagatttaaggatgaaagccctgagttgttcttgggttcttggatctggactacttgttatcttatgcttctcacttctggctaaaacttgcacctcttcttctcttagctaagccccaaaatgaagatttccttcagaagtcttgttagcagaattatttatcagtcacagagagaaaaatctgctatttttctaagtaagagtctcgagaagcagagtttttgtcttgtcattgagaggagtcagcagtcttgttctgtaaaggaccagagatggtaaatactgtcccactcagctctgctggcgcagtacagcagcagcagccccagcacagctgtgttcctgcggagtcccctttacaaagccgctgacccctgatgtgaaactttgtagagcagcagagtggctgcgtgaaacgggaggctggcaggtcctcagataggttctgcagtgttacctgtcacttggaggcagccaacacttctggacattgcatccttattcacacatgtggcagctgaacgaggtgctgttgtgggtgtctcagctctgagggtctttgtgagctcccactgttgtgggtgtctcagctctgagggtctttgtgagctcccactgttgtgggtgtctcagctctgagggtctttgtgagttcccaccaacttttaattattcatgcccttgaccatgtggttgcttggagacctggggtcttctgcagactgaagaagacacatttctagattatttgtcctttttatcctctcaaaaatttaaacactgtacctcttcagtggtcagaagaaagttggaaacttttcctacatattaggcgttagtatgaggacatttgtttgaattatagaaatttgccctgagctgaactgggttgtgttaacacattggtagagctatgattccttcccagttctaagagatacgatctgtaagtccctatgtcaccacattgcttgagatgatcattcagttacttgtcaggatttctcctcttcagagagatttttttttatagcacagattcctttgccccttttatctccttatctggatatgataagtggttatgagggtctcactaactattttgtgtttaccttttatatgtgtaaaactttgcagtagcatttaaagtgtaatttatttttctatcaagtgcactattcatttagtgtgttccagttttatatgacttgtattagaaacactgcactgagttgtttgtacactgaaatgagaactctagatgtaactctattcaaataaaccttcgtgagacattca

SEQ ID NO: 311643 - DNA, 854 bp, Homo sapiens
cgtttaagagcggagcgctccgccctgggggcggagctgggagggagctttaaggggcggacgggcgggaggtcggggtcctccggggattagagccggtgggctcgttgtgggcgccatttctcggcgtctcccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtaagaacaccatctagaattgtgccagggttattttgatagttttgaaagactgtctttatattgtttccaatttatagccagctaataaaatggattcctgtcccctggtaacaagacctcaaataatagaattttattctgggacgtgttttttaagtgtatgattcttttcctttagcattttcaaaataaagagttggtttcttagcatcctccaaaggtgac

SEQ ID NO: 311644 - DNA, 609 bp, Homo sapiens
cttagctcagtttttgtaaagatgaggtctcactatattgcccaggctggtctcaaactcctgggctcaagggatcctcccgccttggcctctcagagcgctaggattacaggtgtgagccactgcatccagccaaaataatttttttgtaattaaaaagaaaaagttaagagccagaatagtcataaccctacccaagttttgtcttaccaaaggagaatagctatttgaaaatttacatagcacttcagctttttcacatcctgattgtagtataggtttccctccatgcagaagtggaatcattaacaaccatgatttatgagtgtccctgtgtatttaaaggattaacactaatcaggcctgtgtcagaattataaattgagaggatatggaaaaaacttaacatctgatgataaaggggtcatttaacaattctagattcctgtcttccataggaagctacagatgaattggatgccttgcttgcatctctaactgagaatctaattgatcacacagttgcacctcaggtaaatatgctttaaaatagtatgatggaaagaaatttctgttttgaaaaatgttcctgctagattccagtttttt

SEQ ID NO: 311645 - DNA, 6502 bp, Homo sapiens
  misc_feature (4685)..(4685): n is a, c, g, or t
cgtttaagagcggagcgctccgccctgggggcggagctgggagggagctttaaggggcggacgggcgggaggtcggggtcctccggggattagagccggtgggctcgttgtgggcgccatttctcggcgtctcccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatgcattcctctgaatattgatttgctgaatagcccagacttattggaaacaacgattggtgatgtaattggggcatctgacactatggaaacatcccaagcactgaatgacgttaatgtagccaccaggcttccgggattaggggaacctgaagttgaatatgagacattaaaagacacctcagagaagctcaaacagcttgagatggagaacagtcctttgctgtcccctcgatccaacatcgatgttaacataaacagccaggaggaagtggtgaagttgactgagaaatgccttaataatgtcattgagagcccaggattgaatgtcatgagagttcctcctgacttcaagagtaacattttgaaggctcaagtagaagcagtgcataaggttacaaaagaagatagcttattaagtcataaaaatgccaatgttcaggatgctgccacaaacagtgctgtgttaaatgagaataatgtgcccctccccaaagagtctcttgagactctgatgcttatcacacctgccgacagtggttctgttctaaaggaagctacagatgaattggatgccttgcttgcatctctaactgagaatctaattgatcacacagttgcacctcaggtgtcttccacatccatgatcacaccccggtggattgttccgctctggtcccattttggcagaagaagctgtcctgaagcagaagtgtttactgaccactgagctctgagggcctgtagctggaatacgcatctctccagcattccgtcctgggatccgtttcagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggctccacctagcggttctatttgttcataacaacttcataacaagcctgcctctggtagtcaacagccttttgaaagctatttccatctagtatcagggtgagagcatccttgatctggctgcctgttagagaaattgcacttttcctgacttacctagaaatcaagaatttaggaaattaatgtggacactataaaggcagacttagggccaacttttttttttttttacaattattacaacactaaagagaagtttagaatatagagagtttttaaatgtctcccattcttttgatttcttactgtactggctatcttaatatttcaagtttacatcaagataaaccctgagaagaactacggagaaatcaaataaaatcctgtcatatttttttcaccctgcctttccacaggaagcactcacaggcaccacacacgtatcatgtaacttatcagtggggtgggttactgttgaagagaccctggggcatttacctcaggcatctgcactcctccgagcccggtggagaatgcaggctgctgtagtctcaggtaatgaaggcacagcacagcagtactccacattgtttcctatttggacatagacttcatttcctttcagtataagctgaataaatttagagctttcaaactggaaaaaaaaatgaaacaaaacaaatacaccaagaccaaaataggcaataggaacaggggtgaagggatgttgtttcttaaatacctaccatgtatgaagctatacacagcatataccgaaagaacctgcattgcactaggaattctgtgttagtttaaaagagatctctaaaacttccccatccctttgggcctgtacaaagaaattctggatgttaaaataatatatactcatcacagaaaaataaagtatagcaatgtccatctgtaattctaatacccagaaataacgctatttagctttataattttcgaatgaacaaggtaaacctcggttgccatggggaagaaggatgatgtggaaaccatattggtaaagttgttaatccctcgttatggagaactgatcttaagctatacctcctggaatttgctttctagttttctgtcctgcaatatgtatataattaagcactaatttgtactgcttagcataaaagaacatccagtcttagatccttaaaacttcatggattggactttcctgggctccttataacataatcgtgtgtccaggcaaacgcacactagtgtctgactggaaagctcaggaattttaatcttgcactgtttcccagggagctgtagtgattggaacccacgtttgcacaaaacatttttgcagaaggaaagtcaacacttcttgctggctgcctccccttagccattatgctaaaaacagcttctgagtttcactggtggggctcttgccagttcttaattataggacatattttctcaaagctgaaggtgacacctagaaccaggggcttgacccaggacatgatggaatgagcatcaaattttcagtgtcttggcaaccgtagatgtcctacagggttaccgttgtgctgctcaccacagagcagctgaggcattatgccttggaagacctaaatctcccatccagttcaggaggtgacaacatccttattttaaacttcctaaaattaggaattaggtagttggacatagtctgtgacctttatgtcgttggatacctgtattcttgacagttagaatattggtagggactttgttaaaattcacttgaatttcaagctcagaggaaactttgtctcatgccctgacatgaagtggcaaacacggaagttcatacttgaatgctgaattggccccgacagattaaatgcgtgttggggattggtttcctgtcatagctgctgctgctgccatgcgcagagctgctgtaacagctcttcctgttctgctcccctgagaacagtgtggtggggagaggcagggctgaggtggtctacgaatgtggcaggtagggaaggggagatgtctgtctcttgagaagagagaggcatgtgtgccggcatccttgatgggttcaaagagaaaggttggagatgatantgggtgagaagcaggctggtgagactgggctgaggttggagaaggggcagccgggggcactgctgagggtttgccgtgcacgcctcggacggagcacggtggggtggcggggagcagatagtgctgcctccctgcgggcagacaggagaggaacctcaactcagtccatttcatagccctgataggggaagtgggagttgacaggatggtttaaaataagacgtgaaggtttcagttacctgctctagactttgcctgagaacttgtaaattaatcagtgagacctaatttgtgacatgtcagtagcatcatcttttgacacacaggaggtcatggtcatttcattcctactcttcaggagacactgctgaacagaggaatgattctgttccttgtgtgcttacttccttaacatttatacattgttttaagaaaaaacttttaaaaatatttcttatagtctcctaacatttgtctctagcctttgcctttgtacaatcacagatatcctatggagatttaaggatgaaagccctgagttgttcttgggttcttggatctggactacttgttatcttatgcttctcacttctggctaaaacttgcacctcttcttctcttagctaagccccaaaatgaagatttccttcagaagtcttgttagcagaattatttatcagtcacagagagaaaaatctgctatttttctaagtaagagtctcgagaagcagagtttttgtcttgtcattgagaggagtcagcagtcttgttctgtaaaggaccagagatggtaaatactgtcccactcagctctgctggcgcagtacagcagcagcagccccagcacagctgtgttcctgcggagtcccctttacaaagccgctgacccctgatgtgaaactttgtagagcagcagagtggctgcgtgaaacgggaggctggcaggtcctcagataggttctgcagtgttacctgtcacttggaggcagccaacacttctggacattgcatccttattcacacatgtggcagctgaacgaggtgctgttgtgggtgtctcagctctgagggtctttgtgagctcccactgttgtgggtgtctcagctctgagggtctttgtgagctcccactgttgtgggtgtctcagctctgagggtctttgtgagttcccaccaacttttaattattcatgcccttgaccatgtggttgcttggagacctggggtcttctgcagactgaagaagacacatttctagattatttgtcctttttatcctctcaaaaatttaaacactgtacctcttcagtggtcagaagaaagttggaaacttttcctacatattaggcgttagtatgaggacatttgtttgaattatagaaatttgccctgagctgaactgggttgtgttaacacattggtagagctatgattccttcccagttctaagagatacgatctgtaagtccctatgtcaccacattgcttgagatgatcattcagttacttgtcaggatttctcctcttcagagagatttttttttatagcacagattcctttgccccttttatctccttatctggatatgataagtggttatgagggtctcactaactattttgtgtttaccttttatatgtgtaaaactttgcagtagcatttaaagtgtaatttatttttctatcaagtgcactattcatttagtgtgttccagttttatatgacttgtattagaaacactgcactgagttgtttgtacactgaaatgagaactctagatgtaactctattcaaataaaccttcgtgagacattca

SEQ ID NO: 311646 - DNA, 6875 bp, Homo sapiens
  misc_feature (4685)..(4685): n is a, c, g, or t
cgtttaagagcggagcgctccgccctgggggcggagctgggagggagctttaaggggcggacgggcgggaggtcggggtcctccggggattagagccggtgggctcgttgtgggcgccatttctcggcgtctcccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatgcattcctctgaatattgatttgctgaatagcccagacttattggaaacaacgattggtgatgtaattggggcatctgacactatggaaacatcccaagcactgaatgacgttaatgtagccaccaggcttccgggattaggggaacctgaagttgaatatgagacattaaaagacacctcagagaagctcaaacagcttgagatggagaacagtcctttgctgtcccctcgatccaacatcgatgttaacataaacagccaggaggaagtggtgaagttgactgagaaatgccttaataatgtcattgagagcccaggattgaatgtcatgagagttcctcctgacttcaagagtaacattttgaaggctcaagtagaagcagtgcataaggttacaaaagaagatagcttattaagtcataaaaatgccaatgttcaggatgctgccacaaacagtgctgtgttaaatgagaataatgtgcccctccccaaagagtctcttgagactctgatgcttatcacacctgccgacagtggttctgttctaaaggaagctacagatgaattggatgccttgcttgcatctctaactgagaatctaattgatcacacagttgcacctcaggtgtcttccacatccatgatcacaccccggtggattgttccgctctggtcccattttggcagaagaagctgtcctgaagcagaagtgtttactgaccactgagctctgagggcctgtagctggaatacgcatctctccagcattccgtcctgggatccgtttcagctagaatatgttggattcaggagcttgtccattatttgtaggtaaaaaaagctgcacgtagatttgacttcaactccgtaaaaaagacagctgtattttccgtccaactggaattgttgaatcacactgcatagctgcccaaaagagagtgtttggtcttgaactttctatacttttataaatgttacaaattcccgaaagaagggaatttctttttctggggtttccttcaaactcttggctccacctagcggttctatttgttcataacaacttcataacaagcctgcctctggtagtcaacagccttttgaaagctatttccatctagtatcagggtgagagcatccttgatctggctgcctgttagagaaattgcacttttcctgacttacctagaaatcaagaatttaggaaattaatgtggacactataaaggcagacttagggccaacttttttttttttttacaattattacaacactaaagagaagtttagaatatagagagtttttaaatgtctcccattcttttgatttcttactgtactggctatcttaatatttcaagtttacatcaagataaaccctgagaagaactacggagaaatcaaataaaatcctgtcatatttttttcaccctgcctttccacaggaagcactcacaggcaccacacacgtatcatgtaacttatcagtggggtgggttactgttgaagagaccctggggcatttacctcaggcatctgcactcctccgagcccggtggagaatgcaggctgctgtagtctcaggtaatgaaggcacagcacagcagtactccacattgtttcctatttggacatagacttcatttcctttcagtataagctgaataaatttagagctttcaaactggaaaaaaaaatgaaacaaaacaaatacaccaagaccaaaataggcaataggaacaggggtgaagggatgttgtttcttaaatacctaccatgtatgaagctatacacagcatataccgaaagaacctgcattgcactaggaattctgtgttagtttaaaagagatctctaaaacttccccatccctttgggcctgtacaaagaaattctggatgttaaaataatatatactcatcacagaaaaataaagtatagcaatgtccatctgtaattctaatacccagaaataacgctatttagctttataattttcgaatgaacaaggtaaacctcggttgccatggggaagaaggatgatgtggaaaccatattggtaaagttgttaatccctcgttatggagaactgatcttaagctatacctcctggaatttgctttctagttttctgtcctgcaatatgtatataattaagcactaatttgtactgcttagcataaaagaacatccagtcttagatccttaaaacttcatggattggactttcctgggctccttataacataatcgtgtgtccaggcaaacgcacactagtgtctgactggaaagctcaggaattttaatcttgcactgtttcccagggagctgtagtgattggaacccacgtttgcacaaaacatttttgcagaaggaaagtcaacacttcttgctggctgcctccccttagccattatgctaaaaacagcttctgagtttcactggtggggctcttgccagttcttaattataggacatattttctcaaagctgaaggtgacacctagaaccaggggcttgacccaggacatgatggaatgagcatcaaattttcagtgtcttggcaaccgtagatgtcctacagggttaccgttgtgctgctcaccacagagcagctgaggcattatgccttggaagacctaaatctcccatccagttcaggaggtgacaacatccttattttaaacttcctaaaattaggaattaggtagttggacatagtctgtgacctttatgtcgttggatacctgtattcttgacagttagaatattggtagggactttgttaaaattcacttgaatttcaagctcagaggaaactttgtctcatgccctgacatgaagtggcaaacacggaagttcatacttgaatgctgaattggccccgacagattaaatgcgtgttggggattggtttcctgtcatagctgctgctgctgccatgcgcagagctgctgtaacagctcttcctgttctgctcccctgagaacagtgtggtggggagaggcagggctgaggtggtctacgaatgtggcaggtagggaaggggagatgtctgtctcttgagaagagagaggcatgtgtgccggcatccttgatgggttcaaagagaaaggttggagatgatantgggtgagaagcaggctggtgagactgggctgaggttggagaaggggcagccgggggcactgctgagggtttgccgtgcacgcctcggacggagcacggtggggtggcggggagcagatagtgctgcctccctgcgggcagacaggagaggaacctcaactcagtccatttcatagccctgataggggaagtgggagttgacaggatggtttaaaataagacgtgaaggtttcagttacctgctctagactttgcctgagaacttgtaaattaatcagtgagacctaatttgtgacatgtcagtagcatcatcttttgacacacaggaggtcatggtcatttcattcctactcttcaggagacactgctgaacagaggaatgattctgttccttgtgtgcttacttccttaacatttatacattgttttaagaaaaaacttttaaaaatatttcttatagtctcctaacatttgtctctagcctttgcctttgtacaatcacagatatcctatggagatttaaggatgaaagccctgagttgttcttgggttcttggatctggactacttgttatcttatgcttctcacttctggctaaaacttgcacctcttcttctcttagctaagccccaaaatgaagatttccttcagaagtcttgttagcagaattatttatcagtcacagagagaaaaatctgctatttttctaagtaagagtctcgagaagcagagtttttgtcttgtcattgagaggagtcagcagtcttgttctgtaaaggaccagagatggtaaatactgtcccactcagctctgctggcgcagtacagcagcagcagccccagcacagctgtgttcctgcggagtcccctttacaaagccgctgacccctgatgtgaaactttgtagagcagcagagtggctgcgtgaaacgggaggctggcaggtcctcagataggttctgcagtgttacctgtcacttggaggcagccaacacttctggacattgcatccttattcacacatgtggcagctgaacgaggtgctgttgtgggtgtctcagctctgagggtctttgtgagctcccactgttgtgggtgtctcagctctgagggtctttgtgagctcccactgttgtgggtgtctcagctctgagggtctttgtgagttcccaccaacttttaattattcatgcccttgaccatgtggttgcttggagacctggggtcttctgcagactgaagaagacacatttctagattatttgtcctttttatcctctcaaaaatttaaacactgtacctcttcagtggtcagaagaaagttggaaacttttcctacatattaggcgttagtatgaggacatttgtttgaattatagaaatttgccctgagctgaactgggttgtgttaacacattggtagagctatgattccttcccagttctaagagatacgatctgtaagtccctatgtcaccacattgcttgagatgatcattcagttacttgtcaggatttctcctcttcagagagatttttttttatagcacagattcctttgccccttttatctccttatctggatatgataagtggttatgagggtctcactaactattttgtgtttaccttttatatgtgtaaaactttgcagtagcatttaaagtgtaatttatttttctatcaagtgcactattcatttagtgtgttccagttttatatgacttgtattagaaacactgcactgagttgtttgtacactgaaatgagaactctagatgtaactctattcaaataaaccttcgtgagacattcaaaaaaaaaaaaaaaaaaaaaaaacaaaccaacacaaaaaaaaaaaaaaaaaaaaaaaaaaaaaaaaaaaaaaaaaaaagggggggggggcagaaaaaaaacgagaggagaacaaaaagatcgaacaacacaacatgtcgtagaacacagaggcacccacaacaaggggaacagataaacaaaacacagaggccgcgaaatagcaaagcagcagagggaacaacaaaatgagggaatatagaaacacacaccctgttcggggcggcaacatacgtgcaaccatcaaggaaacggaccagagacaacaacagaagacagtaggaaacacagcaaatcaagagaaacagcaaataaaaacaataggggaagaaaaa

SEQ ID NO: 311647 - DNA, 2619 bp, Homo sapiens
cgtttaagagcggagcgctccgccctgggggcggagctgggagggagctttaaggggcggacgggcgggaggtcggggtcctccggggattagagccggtgggctcgttgtgggcgccatttctcggcgtctcccgaggagccgcccctttctcagccttgctcggctcttccccgctctggtcgccggggctgcgccgtccccagctcagtgacaaaaatgctgagtttcttccgtagaacactagggcgtcggtctatgcgtaaacatgcagagaaggaacgactccgagaagcacaacgcgccgccacacatattcctgcagctggagattctaagtccatcatcacgtgtcgggtgtcccttctggatggtactgatgttagtgtggacttgccaaaaaaagccaaaggacaagagttgtttgatcagattatgtaccacctggacctgattgaaagcgactattttggtctgagatttatggattcagcacaagtagcacattggttggatggtacaaaaagcatcaaaaagcaagtaaaaattggttcaccctattgtctgcatcttcgagttaagttttattcctcagaaccaaataaccttcgtgaggagctaacccggtatttatttgttcttcagttaaaacaagatattctcagtggaaaattagactgtccctttgatacagcagtgcaattggcagcttataatctgcaagctgaacttggtgactatgatcttgctgagcatagtcctgaacttgtctcagagttcagattcgtgcctattcagactgaagagatggaactggctatttttgagaaatggaaggaatacagaggtcaaacaccagcacaggctgaaaccaattatctgaataaagccaaatggctagaaatgtatggggttgatatgcatgtggtcaaggctagagatgggaatgactatagtttgggactaacaccaacaggagtccttgtttttgaaggagataccaaaattggcttatttttttggccgaagataaccagattggattttaagaagaataaattaaccttggtggttgtagaagatgatgatcagggcaaagaacaggaacatacatttgtctttagactggatcatccaaaagcatgcaaacatttatggaaatgtgctgtggagcatcatgctttcttccgccttcgaggccccgtccaaaagagttctcatcgatcaggatttattcgactaggatcacgatttagatatagtgggaaaacagagtatcagaccacaaaaaccaataaagcaagaagatcaacatcctttgaaagaaggcccagcaaacgatattctagacgaactctacaaatgaaagcatgtgctacaaaacctgaagaacttagtgttcacaataatgtttcgacccaaagtaatggctcccaacaggcttgggggatgagatctgctctgcctgtgagtccttccatttcctctgctcctgtgccagtggagatagagaatcttccacagagtcctggaacagaccagcatgacaggaaatggctctctgctgccagcgactgctgtcaacgtggtggaaaccagtggaacacaagggccttgcccccaccccagaccgcacatagaaactacactgactttgttcatgagcacaatgtgaagaatgcaggaatccgtcatgatgttcattttcctggccatacagccatgactgagatatgagtgttgagcctcttaggctttgggactctttgtcatgcaagttgatggtatacattatctggtgtttataaaggattaatcacattaggagtatttgggagaatttacagtgagtcactagttgttcagtgctgtttgtaattgaattcttccatgaaagggacaaggaatcaaggaagccatatagcatcaatgataatgacaaatgtttgtgttgaaaagagtgtgtataccattgtggttttggaagagttttcagaccttagtatgttcacacatcaccagactgtatctcaggagaaggtttgtgtttgtgaacaaggtgcccattattcccccaccacatgccatccaaagagatcgaggttaaaagaatcagacacactaaaaacacagtggaagcatgtctaggcataatatatcagccttttgagatatttattaaaaacttgttcttatacactattttaatatgtctaaagtgacacataccttaatttaagtgcctaagattttaattaatataatttttaattacaaacacttttactttttaataaacacgaatattttaacttaccaaaagatttagagatcacattaataatgtggctcatgtatagagaaatctgaatgtttagttttgaatggttaactgattaacattcagttatcataacagttaaccagtggttaactgaatggttacattactactgaatggttctataaaatgaaaaacatatttactttgtcttttcatttgactggcttttctctttcatctcatacacctgacagattacccaggtttgcaacagtctcataatctgatcctgtataacctttaaaataaaattctgaagccaaaaccaaaaaaaa

SEQ ID NO: 311648 - DNA, 3366 bp, Homo sapiens
gaaccaatcaggaccggcctggcagtgtcatggctgcccacaggtctgcaggcactcggtacgccgctaacgcggcgaggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggcaagaacttacaggaaaaatctgttccaaaagcagctcaggatttgatgacaaatggttatgtctcccttcaagagaaagacatctttgtgtctggagtgaagattttttatggttctcagactggaacagcgaagggattcgcaacagttcttgctgaagcagttacatccctggatctgcctgtggccattattaatctaaaagaatatgatccagatgatcatctgatagaagaggtgactagtaaaaatgtctgtgtcttcctggttgcgacatacactgacggcctaccaactgaaagtgcagagtggttctgcaaatggttagaggaagcatccattgattttcgatttggcaaaacttacctgaagggtatgagatatgcggtatttggcctgggaaattctgcctatgctagccacttcaacaaggttggcaaaaatgttgacaagtggctctggatgcttggcgcgcatcgtgtgatgagtcgaggggagggcgactgcgacgtggttaaaagcaagcacggcagcattgaggccgacttcagagcatggaagaccaagttcatctcccagctgcaggcacttcagaaaggggagagaaagaagtcctgtggcggccactgcaagaaaggcaaatgtgaatctcaccaacatggctcagaggagagggaggaaggatctcatgagcaggatgaattgcatcatagagacaccgaggaggaagaaccctttgagagctccagtgaagaagagtttggtggtgaggaccatcagagcctaaattccattgttgatgttgaagatttgggcaaaattatggatcatgtgaagaaagaaaagagagaaaaggaacagcaggaagagaagtctggtttgttcaggaacatggggaggaatgaagatggtgaaagaagagctatgataactcctgctctccgagaagcccttactaaacaaggttatcagttgattgggagccactcgggggtgaagctttgcaggtggacaaagtccatgctccgagggagaggaggttgttacaaacacacattctatggaattgagagccatcgctgcatggaaaccaccccgagcttggcgtgtgctaataaatgtgtcttctgttggcggcaccacaccaaccccgtgggcactgagtggcggtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcggagaaagttcagcaagcagtcttaccatggcccacgtgccctggcatgaggaagtggtacagtttgtccgcgagctggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacaataaggcagtaaacacaggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacctcctgaaaagaatcgaagttgtcacaactctcaattattttttaaatactgcatagattgagttttggtttattaccaacccttcccagaattgcgttggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgtaaagacttgcagacatgaaaaa

SEQ ID NO: 311649 - DNA, 3198 bp, Homo sapiens
gaaccaatcaggaccggcctggcagtgtcatggctgcccacaggtctgcaggcactcggtacgccgctaacgcggcgaggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggcaagaacttacaggaaaaatctgttccaaaagcagctcaggatttgatgacaaatggttatgtctcccttcaagagaaagacatctttgtgtctggagtgaagattttttatggttctcagactggaacagcgaagggattcgcaacagttcttgctgaagcagttacatccctggatctgcctgtggccattattaatctaaaagaatatgatccagatgatcatctgatagaagaggtgactagtaaaaatgtctgtgtcttcctggttgcgacatacactgacggcctaccaactgaaagtgcagagtggttctgcaaatggttagaggaagcatccattgattttcgatttggcaaaacttacctgaagggtatgagatatgcggtatttggcctgggaaattctgcctatgctagccacttcaacaaggttggcaaaaatgttgacaagtggctctggatgcttggcgcgcatcgtgtgatgagtcgaggggagggcgactgcgacgtggttaaaagcaagcacggcagcattgaggccgacttcagagcatggaagaccaagttcatctcccagctgcaggcacttcagaaaggggagagaaagaagtcctgtggcggccactgcaagaaaggcaaatgtgaatctcaccaacatggctcagaggagagggaggaaggatctcatgagcaggatgaattgcatcatagagacaccgaggaggaagaaccctttgagagctccagtgaagaagagtttggtggtgaggaccatcagagcctaaattccattgttgatgttgaagatttgggcaaaattatggatcatgtgaagaaagaaaagagagaaaaggaacagcaggaagagaagtctggtttgttcaggaacatggggaggaatgaagatggtgaaagaagagctatgataactcctgctctccgagaagcccttactaaacaaggttatcagttgattgggagccactcgggggtgaagctttgcaggtggacaaagtccatgctccgagggagaggaggttgttacaaacacacattctatggaattgagagccatcgctgcatggaaaccaccccgagcttggcgtgtgctaataaatgtgtcttctgttggcggcaccacaccaaccccgtgggcactgagtggcggtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacaataaggcagtaaacacaggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacctcctgaaaagaatcgaagttgtcacaactctcaattattttttaaatactgcatagattgagttttggtttattaccaacccttcccagaattgcgttggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgtaaagacttgcagacatgaaaaa

SEQ ID NO: 311650 - DNA, 2199 bp, Homo sapiens
atgctctgatgcgaatttcctgcgtcatgcagttaccagtaggagtattcatggttacgaaacacatggtttctcttaaaaatgatgccttggtggtttgtttctgtgctttgacaattttattcaaattgtgatttgtttacttgtcatagtccatgctccgagggagaggaggttgttacaaacacacattctatggaattgagagccatcgctgcatggaaaccaccccgagcttggcgtgtgctaataaatgtgtcttctgttggcggcaccacaccaaccccgtgggcactgagtggcggtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcggagaaagttcagcaagcagtcttaccatggcccacgtgccctggcatgaggaagtggtacagtttgtccgcgagctggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacaataaggcagtaaacacaggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacctcctgaaaagaatcgaagttgtcacaactctcaattattttttaaatactgcatagattgagttttggtttattaccaacccttcccagaattgcgttggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgtaaagacttgcagacatgaaaaa

SEQ ID NO: 311651 - DNA, 1944 bp, Homo sapiens
gctcgacctgtgaatgttagtgtataaaaattttgtagacaaatatttttgtttctcttggacaaacactgtgaggaattgctggatttgtaaacatccatttggacagtttgtcttttttaactggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcggagaaagttcagcaagcagtcttaccatggcccacgtgccctggcatgaggaagtggtacagtttgtccgcgagctggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacaataaggcagtaaacacaggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacctcctgaaaagaatcgaagttgtcacaactctcaattattttttaaatactgcatagattgagttttggtttattaccaacccttcccagaattgcgttggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgtaaagacttgcagacatgaaaaa

SEQ ID NO: 311652 - DNA, 1332 bp, Homo sapiens
gacgtgatagggagaaaagatcagacttgttcatgattttaaaaacattcattttttttttctagggatgtttttacttctgacttgacacatttttttctttccagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacaataaggcagtaaacacaggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacctcctgaaaagaatcgaagttgtcacaactctcaattattttttaaatactgcatagattgagttttggtttattaccaacccttcccagaattgcgttggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgtaaagacttgcagacatgaaaaa

SEQ ID NO: 311653 - DNA, 2502 bp, Homo sapiens
gaaccaatcaggaccggcctggcagtgtcatggctgcccacaggtctgcaggcactcggtacgccgctaacgcggcgaggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggcaagaacttacaggaaaaatctgttccaaaagcagctcaggatttgatgacaaatggttatgtctcccttcaagagaaagacatctttgtgtctggagtgaagattttttatggttctcagactggaacagcgaagggattcgcaacagttcttgctgaagcagttacatccctggatctgcctgtggccattattaatctaaaagaatatgatccagatgatcatctgatagaagaggtgactagtaaaaatgtctgtgtcttcctggttgcgacatacactgacggcctaccaactgaaagtgcagagtggttctgcaaatggttagaggaagcatccattgattttcgatttggcaaaacttacctgaagggtatgagatatgcggtatttggcctgggaaattctgcctatgctagccacttcaacaaggttggcaaaaatgttgacaagtggctctggatgcttggcgcgcatcgtgtgatgagtcgaggggagggcgactgcgacgtggttaaaagcaagcacggcagcattgaggccgacttcagagcatggaagaccaagttcatctcccagctgcaggcacttcagaaaggggagagaaagaagtcctgtggcggccactgcaagaaaggcaaatgtgaatctcaccaacatggctcagaggagagggaggaaggatctcatgagcaggatgaattgcatcatagagacaccgaggaggaagaaccctttgagagctccagtgaagaagagtttggtggtgaggaccatcagagcctaaattccattgttgatgttgaagatttgggcaaaattatggatcatgtgaagaaagaaaagagagaaaaggaacagcaggaagagaagtctggtttgttcaggaacatggggaggaatgaagatggtgaaagaagagctatgataactcctgctctccgagaagcccttactaaacaaggttatcagttgattgggagccactcgggggtgaagctttgcaggtggacaaagtccatgctccgagggagaggaggttgttacaaacacacattctatggaattgagagccatcgctgcatggaaaccaccccgagcttggcgtgtgctaataaatgtgtcttctgttggcggcaccacaccaaccccgtgggcactgagtggcggtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcggagaaagttcagcaagcagtcttaccatggcccacgtgccctggcatgaggaagtggtacagtttgtccgcgagctggtggatctgatccccgaatatgaaattgcatgtgaacacgaacactctaattgcctcctgatagcacacagaaagaccgcagtaccggggctggagcggagtgaagctgtctgctgtaagaggagtggccatgtgagggcatggagtcattagtctcacaaacacactttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgtaaagacttgcagacatgaaaaa

SEQ ID NO: 311654 - DNA, 319 bp, Homo sapiens
  misc_feature (17)..(17): n is a, c, g, or t
agctcggtaccccgggncagtacggatgtgtttgctctgcgcgtccacctccagccggagcacattcccgctttcgggcccgtcgggggtgaagctttgcaggtggacaaaggtattttttttgtttttattcaatatgtctattacatgcaacttttaaatagctattattatacactgtctataaatttactatttagaggtataatttacatttaatttgcacagatttttaaatgattctttaaaatgagttcagcaaattttgatgtagaacctatattcaccaactccaattaagatataagttattatcccc

SEQ ID NO: 311655 - DNA, 2432 bp, Homo sapiens
accaggagatagcaggagagaagtggttgtcaggatggtgaggaggaaggatctcaagagcaggacgaatggcatcacagagacaccaagggaggaagaaccctttgagagctccagtgaagaagagtttggtggtgaggaccatcagagcctaaattccattgttgatgttgaagatttgggcaaaattatggatcatgtgaagaaagaaaagagagaaaaggaacagcaggaagagaagtctggtttgttcaggaacatggggaggaatgaagatggtgaaagaagagctatgataactcctgctctccgagaagcccttactaaacaaggttatcagttgattgggagccactcgggggtgaagctttgcaggtggacaaagtccatgctccgagggagaggaggttgttacaaacacacattctatggaattgagagccatcgctgcatggaaaccaccccgagcttggcgtgtgctaataaatgtgtcttctgttggcggcaccacaccaaccccgtgggcactgagtggcggtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcggagaaagttcagcaagcagtcttaccatggcccacgtgccctggcatgaggaagtggtacagtttgtccgcgagctggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacaataaggcagtaaacacaggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacctcctgaaaagaatcgaagttgtcacaactctcaattattttttaaatactgcatagattgagttttggtttattaccaacccttcccagaattgcgttggatctaaaactactagatctcatcccattcccatgtaaattaccacagaccgcagtaccggggctggagcggagtgaagctgtctgctgtaagaggagtggccatgtgagggcatggagtcattagtctcacaaacacactttggactgaagaggatcatttctttttgttcgtgaggtcactgtccaggcctctcatatcatgaccagacggcgggtctccatcttctttcactcctgtggccctggctgctttacacaatctgttctataaggttcaggtgttttcaagttggaaagatcataaatactcaaaattgttttcaagttagcaagttcttttaacagtcttttatgcaaaaattgaattaataaaataatcttttgtaaagacttgcagacatgaaaaa

SEQ ID NO: 311656 - DNA, 3341 bp, Homo sapiens
gaaccaatcaggaccggcctggcagtgtcatggctgcccacaggtctgcaggcactcggtacgccgctaacgcggcgaggtagctcggtgcgtctcgcggtaccagtgcgaatcatcgggctatccaggtccgagatcctagtctcctgtcggctctgaggaggatggatccttctgcggatacatgggacctcttctcacctttaatatcattatggataaacaggttttacatttatttgggctttgctgttagcattagcctttggatttgtgtccagattgtcatcaagacgcagggcaagaacttacaggaaaaatctgttccaaaagcagctcaggatttgatgacaaatggttatgtctcccttcaagagaaagacatctttgtgtctggagtgaagattttttatggttctcagactggaacagcgaagggattcgcaacagttcttgctgaagcagttacatccctggatctgcctgtggccattattaatctaaaagaatatgatccagatgatcatctgatagaagaggtgactagtaaaaatgtctgtgtcttcctggttgcgacatacactgacggcctaccaactgaaagtgcagagtggttctgcaaatggttagaggaagcatccattgattttcgatttggcaaaacttacctgaagggtatgagatatgcggtatttggcctgggaaattctgcctatgctagccacttcaacaaggttggcaaaaatgttgacaagtggctctggatgcttggcgcgcatcgtgtgatgagtcgaggggagggcgactgcgacgtggttaaaagcaagcacggcagcattgaggccgacttcagagcatggaagaccaagttcatctcccagctgcaggcacttcagaaaggggagagaaagaagtcctgtggcggccactgcaagaaaggcaaatgtgaatctcaccaacatggctcagaggagagggaggaaggatctcatgagcaggatgaattgcatcatagagacaccgaggaggaagaaccctttgagagctccagtgaagaagagtttggtggtgaggaccatcagagcctaaattccattgttgatgttgaagatttgggcaaaattatggatcatgtgaagaaagaaaagagagaaaaggaacagcaggaagagaagtctggtttgttcaggaacatggggaggaatgaagatggtgaaagaagagctatgataactcctgctctccgagaagcccttactaaacaaggttatcagttgattgggagccactcgggggtgaagctttgcaggtggacaaagtccatgctccgagggagaggaggttgttacaaacacacattctatggaattgagagccatcgctgcatggaaaccaccccgagcttggcgtgtgctaataaatgtgtcttctgttggcggcaccacaccaaccccgtgggcactgagtggcggtggaagatggaccagcctgaaatgatcttgaaggaagccattgaaaaccatcagaacatgattaagcagtttaaaggagtaccgggcgtcaaagcagaacgctttgaagaaggaatgacggtaaagcactgtgcattgtccctcgtgggagaaccaataatgtacccagagatcaacaggtttttgaagctactccaccagtgtaaaatttccagcttcctggtcacaaacgcacaatttcctgcggaaatcaggaacctcgagccggttactcagctgtatgtcagtgtggatgccagtaccaaagacagcctgaagaaaatcgaccgcccactcttcaaggatttctggcagagattccttgacagtttaaaagccttggcagtcaagcaacaacgaactgtctacagactgacgctcgtgaaagcatggaacgtggacgagctccaggcctacgcgcagctcgtgtccctggggaatcctgacttcatcgaagtgaagggcgttacctactgcggagaaagttcagcaagcagtcttaccatggcccacgtgccctggcatgaggaagtggtacagtttgtccgcgagctggtggatctgatccccgaatatgaaattgcatgtgaacacgaacactctaattgcctcctgatagcacacagaaagtttaaaattggtggtgaatggtggacatggatcgattataaccgcttccaggagctcatccaggaatatgaagatagtggtggatcaaaaacgttcagcgcaaaggattatatggccagaactcctcactgggcattatttggtgccagtgaaagaggctttgatcccaaggacacaagacatcagagaaagaacaaatcaaaggctatttctggatgttgagattatctgatttcaaggtactgaaggacaaaaacttggatggcctcaaaaggttcttgaacaccactgtgattctccaaggacgaattacgtaaattatactttcatacaaaggagacaataaggcagtaaacacaggagacacgggggacagcgtccacactcagagggcctgggccacagccccgatgtttcttttcagaactcagcccctttcctgattttacttctaagaggaaaattattttggggaggaactacacagtcgtgattagaatttatctgatggttttgtattataacttgtaagacctgccagaatgctagtcccgagagtgtcagacaaggaagaagtccctgggcctcttccccttacccggcccttagatttcatggagcagccacttagcattgaattgcactaccctgagctaaacgtgtctgtgctttctaagataagagcttgatccctttcttctatcttaagacagcacctcctgaaaagaatcgaagttgtcacaactctcaattattttttaaatactgcatagattgagttttggtttattaccaacccttcccagaattgcgttggatctccgtccctgcagcgcagtgaaaccgccttgttgcaacacgatagtcatgtgagggcatgcagtattaacttcacaaccacatttgtactgaagagacatttccttctgtaccgatgttatcgtcactgtcctatatctgccagacggcggtcttcatctctctccctcctggtcctggctcgcttacccctccagtccatttcgtctagcgttttctcctccattacgctactctcaattcggtgcacgcctctcctctctaccttcctcttgccatacttgctatcacctgctcctcgcgacatctctcgtcactcctgtgctacccggctccacctctcctctcttatcgccttatactcctggcctgctctactcg

SEQ ID NO: 311657 - DNA, 1118 bp, Homo sapiens
gaccacaacctgtcctaattccatggggaggacaggtttgggagtgttcccctcctgctccagacaatcccataaggaggtggaggtgctggagccatagctgactggggggcagaggatcaggatgattattcaggggattcaaagcaccaagcagtgccctgtcttccccacctaatggtgggagtctaaaaccttaggtttgggctgtttttccttttgcagcatcaaattatacctcttttgagtaggttcattctgataaaagagtataaaagcctggacatacaggattgcatcctattttctctgctcttacagaatagttgcagttgtattatagtagcataacttaaagaactgtttgtcagccattttttcccaaattctaaggcatattgaggccaagcagcgttacagttaaaaaaattttatttttcttcatgggctcatagctgaaagtggcccaattctggagaatgcagccaatgatgctactctctgggatcaattccaaatttgccctgttcagtcttttcacataacacacacaccacacacacacacacacacagatacacacacacacaccccccaaaccaaacaacaacaacaacaaaacaaaatcacaaacagaaaaccaaactccctacaggaaagcaaacaagaaaatgggcatagtccaccattctattactcccccaaaagggccctcttcacaatgcaagcagagagagtgagatatggctgtgtgcaccgcagtgacttacccttcaaaccaaaaccagaagtccagatagcagtctgagatgtttctctgctctaagcttctagagtaccaacagcagcctacactgacctagaagagcgactttagggccccctgaccaacacacttgggcagctgctgggacactcgttcgcctaacctggccagggcctattgccatgctagacctggcatggttgccaaaatctgttgcagaaccccaaaagttaggttcaagtacctgatgcgcagtaagccaaacactgacacatcggtgcttcagagcagagaaaggtttattcaatttgaccaaagcatgagggtgggagaggcaaattctcaaattcag

SEQ ID NO: 311658 - DNA, 453 bp, Homo sapiens
acatttgaaagacatcctactattaagcatttatttattgactgcttgctgtatgttcaacattgtggaatatcatgggaagataagttataatcttattaaacaaagtgctgggattacaggtgtgacacaccgtactgggccctaggctgtgtttttaaaaagcacttggccttggtgtcttcagtctcttgctctcaggtattgttcagttctgaacttgactgaccactgttggtcatttttgttagagatttgcaggtaaacatttaacgtattgtagtttgggaaatcttttacgtttctgaagagagtgtgggtagttgtaaggactttgctttaaacctaatcaccaaagcaggaacagaaatttaagttccaaaataaatttttaaggtcatttttaatctcacttgtttcatagacgttcaaggacattttcaaagaaacacc

SEQ ID NO: 311659 - DNA, 246 bp, Homo sapiens
acatttgaaagacatcctactattaagcatttatttattgactgcttgctgtatgttcaacattgtggaatatcatgggaagataagttataatcttattaaacaaagagaaaaaggcagcatatggttaaagtatttaaaaagtatattgctgaattcaaagttgtgccggagagagtagtatgatctgaatattcagaaaagcttcatgaaggatttaagacaagctaataatgtttggagaaa

SEQ ID NO: 311660 - DNA, 3763 bp, Homo sapiens
cccgcgagcgtccatccatctgtccggccgactgtccagcgaaaggggctccaggccgggcgcacgtcgacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggtttttttttttttaatctgcatttattagtattctaataaaagcattttgatcggaa

SEQ ID NO: 311661 - DNA, 3710 bp, Homo sapiens
cccgcgagcgtccatccatctgtccggccgactgtccagcgaaaggggctccaggccgggcgcacgtcgacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggtttttttttttttaatctgcatttattagtattctaataaaagcattttgatcggaa

SEQ ID NO: 311662 - DNA, 3566 bp, Homo sapiens
cccgcgagcgtccatccatctgtccggccgactgtccagcgaaaggggctccaggccgggcgcacgtcgacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggtttttttttttttaatctgcatttattagtattctaataaaagcattttgatcggaa

SEQ ID NO: 311663 - DNA, 1430 bp, Homo sapiens
ggtttccgacaggatccagtatgcccatgattcagaatcgatgctcggtaccgctggtgaataacaatgacgtcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggtttttttttttttaatctgcatttattagtattctaataaaagcattttgatcggaa

SEQ ID NO: 311664 - DNA, 3709 bp, Homo sapiens
cccgcgagcgtccatccatctgtccggccgactgtccagcgaaaggggctccaggccgggcgcacgtcgacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggtttttttttttttaatctgcatttattagtattctaataaaagcattttgatcggaa

SEQ ID NO: 311665 - DNA, 1425 bp, Homo sapiens
cccgcgagcgtccatccatctgtccggccgactgtccagcgaaaggggctccaggccgggcgcacgtcgacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcacacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagcccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggtttttttttttttaatctgcatttattagtattctaataaaagcattttgatcggaa

SEQ ID NO: 311666 - DNA, 3093 bp, Homo sapiens
cccgcgagcgtccatccatctgtccggccgactgtccagcgaaaggggctccaggccgggcgcacgtcgacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtacttgtcttctccttagcagatgggagaggccgggatggggagtgctggtggggatcagggacttgatggattatgtaaatgtcttctcttgcattctaatgaaaagtctgcagttcttcctttgaccagagtctactctacccctcccatcaccaacagggagaaatccccgttttctaattccagcttgtgtaaaaaactgaatgaattattcatggtggtagtaagagtactccttgcagaacctgcctgcctctttctgcccaatcttccctctccttctcgccttccccacttaataatcaaaatggcagtcacacttacacatcttcgtgtcaggaattgtaacacaaatgtcagctttgcaaatatccatgactgtgccagccccatcatgctgaattcctggcatcatgcagcttggtttccaccaacccccactctcaacctcccaacctccaggaagaagttgcttagcaaccgtatctgcttcccaccagcggactggcagctgcatcttaagcgggaaggaaaccagtggaatagcaatgtgattttgatggtggtgttattaggcatggagactgtgaactctgtgcagttgccttctaaaggaagctgaaaatccacaatgctgcacctctcttcgatccacctctacccttccattgctccacaaagcttttttccaacaagtgttccaggccagtagttgaaattattaagtccctccattatagtaatataggacatgacttccctggccacccccatgttctcaaacatgcctgctctgatatgctggccaggaaaacaaacagggatgtgacttttatatatgcttgccttctgtaaaaggaaagaataaagaagacttttatttacaga

SEQ ID NO: 311667 - DNA, 1579 bp, Homo sapiens
tattgacatttgaactgatgataggatgtttgaagtttgcttcaaaatatatagttcagcatgaaagtggttagtgagaaatataataggaaacaagattgaccgtaaaccaaattgttacagctggctgacacacacgtcgtagttccttttgttcttcactgtattttggtatagttttgaaatttttcataataacaaaaggctattttcaatgcgtggtcctgagcaaggatatagaaagctccatctttgggtaggagtggttgagctgtagtgcacaaactggatgctgttgctttgattgttttgattgttcaagaccttttgactccagcagagctccttgatgagcttctctcagcgtctggacagtgaccatgtgtcacgtgctggtgaacccctggccagggcccaataaatattgaatgagtaaatgaaagccagaagacctaaccgtgatccctttcttcttgtctttgcaagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtacttgtcttctccttagcagatgggagaggccgggatggggagtgctggtggggatcagggacttgatggattatgtaaatgtcttctcttgcattctaatgaaaagtctgcagttcttcctttgaccagagtctactctacccctcccatcaccaacagggagaaatccccgttttctaattccagcttgtgtaaaaaactgaatgaattattcatggtggtagtaagagtactccttgcagaacctgcctgcctctttctgcccaatcttccctctccttctcgccttccccacttaataatcaaaatggcagtcacacttacacatcttcgtgtcaggaattgtaacacaaatgtcagctttgcaaatatccatgactgtgccagccccatcatgctgaattcctggcatcatgcagcttggtttccaccaacccccactctcaacctcccaacctccaggaagaagttgcttagcaaccgtatctgcttcccaccagcggactggcagctgcatcttaagcgggaaggaaaccagtggaatagcaatgtgattttgatggtggtgttattaggcatggagactgtgaactctgtgcagttgccttctaaaggaagctgaaaatccacaatgctgcacctctcttcgatccacctctacccttccattgctccacaaagcttttttccaacaagtgttccaggccagtagttgaaattattaagtccctccattatagtaatataggacatgacttccctggccacccccatgttctcaaacatgcctgctctgatatgctggccaggaaaacaaacagggatgtgacttttatatatgcttgccttctgtaaaaggaaagaataaagaagacttttatttacaga

SEQ ID NO: 311668 - DNA, 3722 bp, Homo sapiens
cccgcgagcgtccatccatctgtccggccgactgtccagcgaaaggggctccaggccgggcgcacgtcgacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggtttttttttttttaatctgcatttattagtattctaataaaagcattttgatcggaa

SEQ ID NO: 311669 - DNA, 2249 bp, Homo sapiens
tattgacatttgaactgatgataggatgtttgaagtttgcttcaaaatatatagttcagcatgaaagtggttagtgagaaatataataggaaacaagattgaccgtaaaccaaattgttacagctggctgacacacacgtcgtagttccttttgttcttcactgtattttggtatagttttgaaatttttcataataacaaaaggctattttcaatgcgtggtcctgagcaaggatatagaaagctccatctttgggtaggagtggttgagctgtagtgcacaaactggatgctgttgctttgattgttttgattgttcaagaccttttgactccagcagagctccttgatgagcttctctcagcgtctggacagtgaccatgtgtcacgtgctggtgaacccctggccagggcccaataaatattgaatgagtaaatgaaagccagaagacctaaccgtgatccctttcttcttgtctttgcaagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggtttttttttttttaatctgcatttattagtattctaataaaagcattttgatcggaa

SEQ ID NO: 311670 - DNA, 4123 bp, Homo sapiens
cccgcgagcgtccatccatctgtccggccgactgtccagcgaaaggggctccaggccgggcgcacgtcgacccgggggaccgaggccaggagaggggccaagagcgcggctgacccttgcgggccggggcaggggacggtggccgcggccatgcagtcctgtgccagggcgtgggggctgcgcctgggccgcggggtcgggggcggccgccgcctggctgggggatcggggccgtgctgggcgccgcggagccgggacagcagcagtggcggcggggacagcgccgcggctggggcctcgcgcctcctggagcgccttctgcccagacacgacgacttcgctcggaggcacatcggccctggggacaaagaccagagagagatgctgcagaccttggggctggcgagcattgatgaattgatcgagaagacggtccctgccaacatccgtttgaaaagacccttgaaaatggaagaccctgtttgtgaaaatgaaatccttgcaactctgcatgccatttcaagcaaaaaccagatctggagatcgtatattggcatgggctattataactgctcagtgccacagacgattttgcggaacttactggagaactcaggatggatcacccagtatactccataccagcctgaggtgtctcaggggaggctggagagtttactcaactaccagaccatggtgtgtgacatcacaggcctggacatggccaatgcatccctgctggatgaggggactgcagccgcagaggcactgcagctgtgctacagacacaacaagaggaggaaatttctcgttgatccccgttgccacccacagacaatagctgttgtccagactcgagccaaatatactggagtcctcactgagctgaagttaccctgtgaaatggacttcagtggaaaagatgtcagtggagtgttgttccagtacccagacacggaggggaaggtggaagactttacggaactcgtggagagagctcatcagagtgggagcctggcctgctgtgctactgaccttttagctttgtgcatcttgaggccacctggagaatttggggtagacatcgccctgggcagctcccagagatttggagtgccactgggctatgggggaccccatgcagcattttttgctgtccgagaaagcttggtgagaatgatgcctggaagaatggtgggggtaacaagagatgccactgggaaagaagtgtatcgtcttgctcttcaaaccagggagcaacacattcggagagacaaggctaccagcaacatctgtacagctcaggccctcttggcgaatatggctgccatgtttgcaatctaccatggttcccatgggctggagcatattgctaggagggtacataatgccactttgattttgtcagaaggtctcaagcgagcagggcatcaactccagcatgacctgttctttgataccttgaagattcagtgtggctgctcagtgaaggaggtcttgggcagggccgctcagcggcagatcaattttcggctttttgaggatggcacacttggtatttctcttgatgaaacagtcaatgaaaaagatctggacgatttgttgtggatctttggttgtgagtcatctgcagaactggttgctgaaagcatgggagaggagtgcagaggtattccagggtctgtgttcaagaggaccagcccgttcctcacccatcaagtgttcaacagctaccactctgaaacaaacattgtccggtacatgaagaaactggaaaataaagacatttcccttgttcacagcatgattccactgggatcctgcaccatgaaactgaacagttcgtctgaactcgcacctatcacatggaaagaatttgcaaacatccacccctttgtgcctctggatcaagctcaaggatatcagcagcttttccgagagcttgagaaggatttgtgtgaactcacaggttatgaccaggtctgtttccagccaaacagcggagcccagggagaatatgctggactggccactatccgagcctacttaaaccagaaaggagaggggcacagaacggtttgcctcattccgaaatcagcacatgggaccaacccagcaagtgcccacatggcaggcatgaagattcagcctgtggaggtggataaatatgggaatatcgatgcagttcacctcaaggccatggtggataagcacaaggagaacctagcagctatcatgattacatacccatccaccaatggggtgtttgaagagaacatcagtgacgtgtgtgacctcatccatcaacatggaggacaggtctacctagacggggcaaatatgaatgctcaggtgggaatctgtcgccctggagacttcgggtctgatgtctcgcacctaaatcttcacaagaccttctgcattccccacggaggaggtggtcctggcatggggcccatcggagtgaagaaacatctcgccccgtttttgcccaatcatcccgtcatttcactaaagcggaatgaggatgcctgtcctgtgggaaccgtcagtgcggccccatggggctccagttccatcttgcccatttcctgggcttatatcaagatgatgggaggcaagggtcttaaacaagccacggaaactgcgatattaaatgccaactacatggccaagcgattagaaacacactacagaattcttttcaggggtgcaagaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggtttttttttttttaatctgcatttattagtattctaataaaagcattttgatcggaagaatgcctttctcttggtgtactttatagttttaccaccgttacaacctagattcagtgggagctgaagggcaatgagaacacccaacccaatagccattgttacatcatcagttttgcctttgactggctgaagaaacagttgtcttggtcaacagtgaaaaccactttgaccctttttgttggaactgagttagagtgcatgtaactgtactccagctatggaaggtcaatcaaatagcaatttatcttttctcatttaagtccagaggtaataagccaagcactggtgctccttcagttttcccgctctgccctcctttgcataaaattttcatccgcatgtctcaagaaggctgtt

SEQ ID NO: 311671 - DNA, 1194 bp, Homo sapiens
ctaatcttgggctgaaacaactttcctgaacaggttatgtgggtcatgaatttattttggacacgagacccttcaaaaagtctgcaaatattgaggctgtggatgtggccaagagactccaggattatggatttcacgcccctaccatgtcctggcctgtggcagggaccctcatggtggagcccactgagtcggaggacaaggcagagctggacagattctgtgatgccatgatcagcattcggcaggaaattgctgacattgaggagggccgcatcgaccccagggtcaatccgctgaaggtgcgtaggccctggaacattgcttgaaatgttccttaaactagaaaatgatgtctggacagtgtaccagcaactcccgaactctcaactgaggatgatactcttccctagaataagatgtctccacactccctgacctgcgttacatcttcccactgggaccggccttattccagagaggtggcagcattcccactccccttcgtgaaaccagagaacaaattctggccaacgattgcccggattgatgacatatatggagatcagcacctggtttgtacctgcccacccatggaagtttatgagtctccattttctgaacaaaagagggcgtcttcttagtcctctctccctaagtttaaaggactgatttgatgcctctccccagagcatttgataagcaagaaagatttcatctcccaccccagcctcaagtaggagttttatatactgtgtatatctctgtaatctctgtcaaggtaaatgtaaatacagtagctggagggagtcgaagctgatggttggaagacggatttgctttggtattctgcttccacatgtgccagttgcctggattgggagccattttgtgttttgcgtagaaagttttaggaactttaacttttaatgtggcaagtttgcagatgtcatagaggctatcctggagacttaatagacatttttttgttccaaaagagtccatgtggactgtgccatctgtgggaaatcccagggcaaatgtttacattttgtataccctgaagaactctttttcctctaatatgcctaatctgtaatcacatttctgagtgttttcctctttttctgtgtgaggtttttttttttttaatctgcatttattagtattctaataaaagcattttgatcggaa

SEQ ID NO: 311672 - DNA, 1432 bp, Homo sapiens
tcacgtatgttttaaatattcaaaagtttctgtcagaaaacagtattttggaattaaatttctagaatctttcataatattctctcctctctactgaacatagtactaggttggtaactggaggatcccagaaagtcatgctaatttttctaacaaaacaggccttgctgtctctaactctgatctgatatcctgctttgagcaaataaaagagccctggaatgtgaagagacatgagacagtagtcagcttctcaggtaggtaagcatgaatgaagcagataacagagacgagggatacgaaggtcagaaagaatttcagaccttaaaatgtggtatagaatgctctgcttccatggaaaggtttcctaaaaagccatttatttctctagctcccaaataggagcatcttttgtcccatacccttaaattctttaaggatcctacttcctatttagtgattttccttagagggtaccgtgagagctaaagtcctctttatggcttataaggtgctgcatgatatgcctgctcttccattgttttgggggagtataagaatatttctgagtattttagaggaactgcatgttagatcatttaacgtttcttttcccatcatgtctgaaatgtgtaagaggagtggtgatattaagatttgtttcagaaatcacaggaacatgaatgacagatgttacttctctatttttttttaatattagcaatcctaacagatttcgagtgatagctcatcattgttttcatttgcagttgccttttggtaggtgatattgagcacttttttatatatctattggtcatttgtatatatttgttggcaaaatatttttttcactctttcaaccattttttagttggattattattgttattattatacttgcttttgctttgaattttctatatattttgaatattaagcttttctgatatatacagtttgctgttgtgagcatgctgcaataaatgtgcaagtatacgtatcattttcatataataaactatttttctttgggtagatacccaatgatgagatttctgaatcaaatgatagttctggccaggcgtgagccaccgcacccaaccaaatctatacatttcaatgaaggatttaatttatttatattcaaggtaaatattaatatgtaaggttttgttactatcataatgttaattattttcttgtcttattttttctttttatctgtctttgtagtttaataaaattctgtcatgttgtgatttgatttatttcactttgttttgtaagacctgttagttttatacttttatatattttaataatggtgaatatcaatctcttgtttttatattagaattttttttaacatctttcataggcccagtctagtggtaattagtttccccagcatttatttgtcagggtaaga

SEQ ID NO: 311673 - DNA, 1355 bp, Homo sapiens
tcacgtatgttttaaatattcaaaagtttctgtcagaaaacagtattttggaattaaatttctagaatctttcataatattctctcctctctactgaacatagtactaggttggtaactggaggatcccagaaagtcatgctaatttttctaacaaaacaggccttgctgtctctaactctgatctgatatcctgctttgagcaaataaaagagccctggaatgtgaagagacatgagacagtagtcagcttctcaggtaggtaagcatgaatgaagcagataacagagacgagggatacgaaggtcagaaagaatttcagaccttaaaatgtggtatagaatgctctgcttccatggaaaggtttcctaaaaagccatttatttctctagctcccaaataggagcatcttttgtcccatacccttaaattctttaaggatcctacttcctatttagtgattttccttagagggtaccgtgagagctaaagtcctctttatggcttataaggtgctgcatgatatgcctgctcttccattgttttgggggagtataagaatatttctgagtattttagaggaactgcatgttagatcatttaacgtttcttttcccatcatgtctgaaatgtgtaagaggagtggtgatattaagatttgtttcagaaatcacaggaacatgaatgacagatgttacttctctatttttttttaatattagcaatcctaacagatttcgagtgatagctcatcattgttttcatttgcagttgccttttggtaggtgatattgagcacttttttatatatctattggtcatttgtatatatttgttggcaaaatatttttttcactctttcaaccattttttagttggattattattgttattattatacttgcttttgctttgaattttctatatattttgaatattaagcttttctgatatatacagtttgctgttgtgagcatgctgcaataaatgtgcaagtatacgtatcattttcatataataaactatttttctttgggtagatacccaatgatgagatttctgaatcaaatgatagttctggccaggcgtggtagctcacgcctgtaatcccaacactttgggaggtagaggcgggcaggtcatgaggtcagaagtttgagaccagcctgagcgatatggtgaaaccccgtctctactaaaaatacaaaagttagccaggcgtggtggcacttgcctgcagccccaactcctcaggaggctgacacagaagaattgcttgaacctgggagtcagtggttgcagtgagctgagatcgtaccactgcactccagcctggacaactaagactccatctca

SEQ ID NO: 311674 - DNA, 5262 bp, Homo sapiens
gccggagtttccaggtctcgacttcactgctctgtgtcctctgctccaggaggcccagcctgtgtggccctgtgacctgcaggtattggaagagccacagctaagatgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtattgctctctctaagccagacctgattacttatctggagcaaggaaaagagccctggaatatgaagcaacatgagatggtggatgaacccacaggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacataccggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaagcttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaaggatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaacctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtgggaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccactactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcgagaggctgaggcaggagaatggcgtgaacccgggaggcggagcttgcagtgagccgagatcacgccactgcactcaagcctgggcgacagagcgagactccgtctcaaaaaaaaaaaaagaaaattcatactagagagaaaccctacaaatataaagaatgtggcaaatcttttaaccggtcttcaacctttactaaacataaggtaattcatactggagtaaaactctacaaatgtgaagaatgtggcaaatcctttttctggtcctcagccctaaccagacataagaaaattcatactggacagcaaccctacaaacaggaaaaatttggcaaagcctttaaccagttttcacaccttactacagataagataactcatattggagagaaatcttacaagtgtgaataatgtggtaaagtctataaaaagtcctgaattcttaacagacataatattattcatactggagagaaactctacaaacctgaaagatgtgccaacgcttttgacaagtcaaacttttctaaacatcaagaaaatcatgctgctgagaaatcctagaaatgtgaagaatgtgacaaagcctctaaatgattgtcacacttgatcgtaggtaagataattcatactggagaaaactaccagtgtgaacaatgtggccaagctttgaaccaatgctcacaccttaatgcataggaaagcatttatgcttgagaaaaagtgaacaaatatagacaaaaagccattaatacctgctcacatcgtactcaaaatcagagcgttcatactaaataagaagtgtaattactgtcaaacgactgatcagaaaatatgtctttaaagtacagaagagtattttgaaaaagcattacaaatatgaagaggcattatttatgaccttttctatggaaagacggagtcttgctccatcgccaggctggagtgcagtggcgcgatctcgtcccactgctcactgcaacctctgcctcccctattgaagtgattctcctgtctcagcctcctgagtagctgggactacaggcacacaccaccacgctcagctaatttttgtattttcagaagagacggggtttcatcatattcaccaggctggtcttgatctcttgacctcgtgataccctcacctcaccctcccaaagtgctgggactacaggcgtgagccaccgcacccaaccaaatctatacatttcaatgaaggatttaatttatttatattcaaggtaaatattaatatgtaaggttttgttactatcataatgttaattattttcttgtcttattttttctttttatctgtctttgtagtttaataaaattctgtcatgttgtgatttgatttatttcactttgttttgtaagacctgttagttttatacttttatatattttaataatggtgaatatcaatctcttgtttttatattagaattttttttaacatctttcataggcccagtctagtggtaattagtttccccagcatttatttgtcagggtaaga

SEQ ID NO: 311675 - DNA, 5090 bp, Homo sapiens
gccggagtttccaggtctcgacttcactgctctgtgtcctctgctccaggaggcccagcctgtgtggccctgtgacctgcaggtattggaagagccacagctaagatgccaggaacccctggaagcctagaaatgggactgttgacatttagggatgtggccatagaattctctccggaggagtggcaatgtctggacactgcacagcagaatttatataggaatgtgatgttagagaactacagaaacctggccttcctgggtattgctctctctaagccagacctgattacttatctggagcaaggaaaagagccctggaatatgaagcaacatgagatggtggatgaacccacaggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacataccggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaagcttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaaggatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaacctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtgggaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccactactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcgagaggctgaggcaggagaatggcgtgaacccgggaggcggagcttgcagtgagccgagatcacgccactgcactcaagcctgggcgacagagcgagactccgtctcaaaaaaaaaaaaagaaaattcatactagagagaaaccctacaaatataaagaatgtggcaaatcttttaaccggtcttcaacctttactaaacataaggtaattcatactggagtaaaactctacaaatgtgaagaatgtggcaaatcctttttctggtcctcagccctaaccagacataagaaaattcatactggacagcaaccctacaaacaggaaaaatttggcaaagcctttaaccagttttcacaccttactacagataagataactcatattggagagaaatcttacaagtgtgaataatgtggtaaagtctataaaaagtcctgaattcttaacagacataatattattcatactggagagaaactctacaaacctgaaagatgtgccaacgcttttgacaagtcaaacttttctaaacatcaagaaaatcatgctgctgagaaatcctagaaatgtgaagaatgtgacaaagcctctaaatgattgtcacacttgatcgtaggtaagataattcatactggagaaaactaccagtgtgaacaatgtggccaagctttgaaccaatgctcacaccttaatgcataggaaagcatttatgcttgagaaaaagtgaacaaatatagacaaaaagccattaatacctgctcacatcgtactcaaaatcagagcgttcatactaaataagaagtgtaattactgtcaaacgactgatcagaaaatatgtctttaaagtacagaagagtattttgaaaaagcattacaaatatgaagaggcattatttatgaccttttctatggaaagacggggtttcatcatattcaccaggctggtcttgatctcttgacctcgtgataccctcacctcaccctcccaaagtgctgggactacaggcgtgagccaccgcacccaaccaaatctatacatttcaatgaaggatttaatttatttatattcaaggtaaatattaatatgtaaggttttgttactatcataatgttaattattttcttgtcttattttttctttttatctgtctttgtagtttaataaaattctgtcatgttgtgatttgatttatttcactttgttttgtaagacctgttagttttatacttttatatattttaataatggtgaatatcaatctcttgtttttatattagaattttttttaacatctttcataggcccagtctagtggtaattagtttccccagcatttatttgtcagggtaaga

SEQ ID NO: 311676 - DNA, 5069 bp, Homo sapiens
caacctgctcacatcgtactcaaattcagagcgttcatactaaataagaagtgtaattactgtcaaacgactgatcagaaaatatgtctttaaagtacagaagagtattttgaaaaagcattacaaatatgaagaggcattatttatgaccttttctatggaaaggtatatgtcctcattttcctcaagacttttggccagagcagagcatggaagattcttttcaaaaagtattactgagaaaatatgaaaaatgtggacatgagaatttacagttaagaaaaggttgtaaaagtgtggatgagtgtaaggtgcacaaagaaggttataataaacttaaccagtgtctcacaactgcccagagcaaagtatttcaatgtgggaaatatttgaaagtcttctataaatttttaaattcaaacagacatacgataagacataccggaaagaaatgcttcaaatgtaaaaaatgtgtcaagtcattttgcatccgtttacacaaaacccaacataaatgcgtttatattacagagaagtcctgtaaatgtaaagaatgtgaaaaaacctttcattggtcctcaacccttactaatcataaggaaattcatactgaagataaaccctacaaatgtgaagaatgtggcaaagcttttaagcagctctcaacccttactacacataaaataatctgtgctaaagagaaaatctacaagtgtgaagaatgtggcaaagcatttctatggtcctcaaccctaactagacataagaggatacacactggagagaaaccctacaaatgtgaagaatgtggcaaagcttttagccattcttcaacccttgctaaacataagagaattcatactggagagaaaccctacaaatgtgaagaatgtggcaaagcttttagccgttcttcaacccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaagcttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagatttcatactagagagaaacccttcaaatgtaaagaatgtggcaaaggatttatatggtcttcaaccctaactagacataagaggatacacactggagagaagccctacaaatgtgaagaatgtggcaaagcttttaggcaatcctcaacccttactaaacataagataattcatactggagagaaaccctacaaatttgaagaatgtggcaaagcttttagacaatccttaacccttaataaacataagataattcatagtagagagaaaccctacaaatgtaaagaatgtggcaaagcttttaagcaattctcaacccttactacacataaaataattcatgctggaaagaaactctacaaatgtgaagaatgtggcaaagcttttaatcattcctcaagtctttctacacataagataattcatactggagagaagtcttacaagtgtgaagaatgtggcaaagcatttctatggtcctcaaccctaagaagacataagaggatacacactggagagaaaccctacaaatgtgaagaatgtggcaaagcttttagccattcttcagcccttgctaaacataagagaattcatactggagagaaaccctacaaatgtaaagaatgtggcaaagcttttagcaattcctcaacccttgctaatcataagataactcatactgaagagaaaccctacaaatgtaaagaatgtgacaaaacttttaagcgactctcaacccttactaaacataaaataatacatgctggagagaaactctacaaatgtgaagaatgtggcaaagcttttaatcgatcttcaaatcttactatacataagtttattcatactggagagaaaccttacaagtgtgaagaatgtggcaaagcatttaactggtcctcaagccttactaaacataaaagaattcatactagagagaaacccttcaaatgtaaagaatgtggcaaagcatttatatggtcttcaaccctaactagacataagaggatacacactggagagaagccctacaaatgtgaagaatgtggcaaagcttttagccgttcctcaacccttactaagcataagacaattcatactggagagaaaccctacaaatgtaaagaatgtggcaaagcttttaagcactcctcagcccttgctaaacataaaataatacatgctggagagaaactctacaaatgtgaggaatgtggcaaagcttttaatcaatcttcaaatcttacgacacataagataattcatactaaagagaaaccttccaagagtgaagaatgtgacaaagcatttatctggtcctcaacccttactgaacataagagaattcataccagagagaaaacctacaaatgtgaagaatgtggcaaagcatttagccagccttcacaccttactacacataagaggatgcacactggagagaaaccctacaaatgtgaagaatgtggcaaagcttttagccaatcctcaacccttactacacataagataattcatactggagagaaaccctacaaatgtgaagaatgtggcaaagcttttaggaaatcttcaactcttactgaacataagataattcatactggagagaaaccctacaaatgtgaagaatgtggcaaagcatttagccaatcctcaaccctaactagacatacgaggatgcacactggagagaaaccatacaaatgtgaagaatgtgggaaagcttttaatcgatcctcaaagcttactacacataagataattcatactggagagaaaccttacaagtgtgaagaatgtggcaaagcatttatatcatcctcaaccctaaatggacataagagaattcatactagagagaaaccctacaaatgtgaagaatgtggcaaagcatttagccaatcttcaaccctaactagacataagaggttgcacaccggagagaaaccctacaaatgtggagaatgtggcaaagcctttaaagagtcctcagctcttactaaacataagataattcacactggagagaaaccctacaaatgtgaaaaatgtggcaaagcctttaaccagtcttcaatccttactaaccataagaaaattcatactatcacacctgtaatcccactactttgggaggccgaggcgggcggatcacgaggtcaggagatggagaccatcctggctaacacagtgaaaccccttctctactaaaaaatacaaaaaattagccgggcgtggtggcgggcgcctgtagtcccagctatgcgagaggctgaggcaggagaatggcgtgaacccgggaggcggagcttgcagtgagccgagatcacgccactgcactcaagcctgggcgacagagcgagactccgtctcaaaaaaaaaaaaagaaaattcatactagagagaaaccctacaaatataaagaatgtggcaaatcttttaaccggtcttcaacctttactaaacataaggtaattcatactggagtaaaactctacaaatgtgaagaatgtggcaaatcctttttctggtcctcagccctaaccagacataagaaaattcatactggacagcaaccctacaaacaggaaaaatttggcaaagcctttaaccagttttcacaccttactacagataagataactcatattggagagaaatcttacaagtgtgaataatgtggtaaagtctataaaaagtcctgaattcttaacagacataatattattcatactggagagaaactctacaaacctgaaagatgtgccaacgcttttgacaagtcaaacttttctaaacatcaagaaaatcatgctgctgagaaatcctagaaatgtgaagaatgtgacaaagcctctaaatgattgtcacacttgatcgtaggtaagataattcatactggagaaaactaccagtgtgaacaatgtggccaagctttgaaccaatgctcacaccttaatgcataggaaagcatttatgcttgagaaaaagtgaacaaatatagacaaaaagccattaatacctgctcacatcgtactcaaaatcagagcgttcatactaaataagaagtgtaattactgtcaaacgactgatcagaaaatatgtctttaaagtacagaagagtattttgaaaaagcattacaaatatgaagaggcattatttatgaccttttctatggaaagacggagtcttgctccatcgccaggctggagtgcagtggcgcgatctcgtcccactgctcactgcaacctctgcctcccctattgaagtgattctcctgtctcagcctcctgagtagctgggactacaggcacacaccaccacgctcagctaatttttgtattttcagaagagacggggtttcatcatattcaccaggctggtcttgatctcttgacctcgtgataccctcacctcaccctcccaaagtgctgggactacaggcgtgagccaccgcacccaaccaaatctatacatttcaatgaaggatttaatttatttatattcaaggtaaatattaatatgtaaggttttgttactatcataatgttaattattttcttgtcttattttttctttttatctgtctttgtagtttaataaaattctgtcatgttgtgatttgatttatttcactttgttttgtaagacctgttagttttatacttttatatattttaataatggtgaatatcaatctcttgtttttatattagaattttttttaacatctttcataggcccagtctagtggtaattagtttccccagcatttatttgtcagggtaaga

SEQ ID NO: 311677 - DNA, 1519 bp, Homo sapiens
cagatcgaatcgagctcgtacggtaatcctctacggatcgaacagctggcaatgtgtgactgaatgtgggaccgtcgtttatatagggctcgcagaccgtgagctagacataagaggatacacactggagagaaaccctacaaatataaagaatgtggcaaatcttttaaccggtcttcaacctttactaaacataaggtaattcatactggagtaaaactctacaaatgtgaagaatgtggcaaatcctttttctggtcctcagccctaaccagacataagaaaattcatactggacagcaaccctacaaacaggaaaaatttggcaaagcctttaaccagttttcacaccttactacagataagataactcatattggagagaaatcttacaagtgtgaataatgtggtaaagtctataaaaagtcctgaattcttaacagacataatattattcatactggagagaaactctacaaacctgaaagatgtgccaacgcttttgacaagtcaaacttttctaaacatcaagaaaatcatgctgctgagaaatcctagaaatgtgaagaatgtgacaaagcctctaaatgattgtcacacttgatcgtaggtaagataattcatactggagaaaactaccagtgtgaacaatgtggccaagctttgaaccaatgctcacaccttaatgcataggaaagcatttatgcttgagaaaaagtgaacaaatatagacaaaaagccattaatacctgctcacatcgtactcaaaatcagagcgttcatactaaataagaagtgtaattactgtcaaacgactgatcagaaaatatgtctttaaagtacagaagagtattttgaaaaagcattacaaatatgaagaggcattatttatgaccttttctatggaaagacggagtcttgctccatcgccaggctggagtgcagtggcgcgatctcgtcccactgctcactgcaacctctgcctcccctattgaagtgattctcctgtctcagcctcctgagtagctgggactacaggcacacaccaccacgctcagctaatttttgtattttcagaagagacggggtttcatcatattcaccaggctggtcttgatctcttgacctcgtgataccctcacctcaccctcccaaagtgctgggactacaggcgtgagccaccgcacccaaccaaatctatacatttcaatgaaggatttaatttatttatattcaaggtaaatattaatatgtaaggttttgttactatcataatgttaattattttcttgtcttattttttctttttatctgtctttgtagtttaataaaattctgtcatgttgtgatttgatttatttcactttgttttgtaagacctgttagttttatacttttatatattttaataatggtgaatatcaatctcttgtttttatattagaattttttttaacatctttcataggcccagtctagtggtaattagtttccccagcatttatttgtcagggtaaga

SEQ ID NO: 311678 - DNA, 1238 bp, Homo sapiens
acaggtgggagccaccacccctggtcaaccatcataattacttcatttacatagtcactgttgaggagtatgttatttaaattctttgtaaatttatagtttctgaaatttctcttgatactgatttgtagttttattctgctgtggtctaagtaggtagttcgtataattttgatttggggggatactttgttgatttgccagatttcctatctcaatggtctctctaatgctgtgagtagaatgttgaatttctccactattattgtattactgtctatctcgttctatagatttaataatatttctttgtaaatcagggtgctgtgatgttgggttcatatatatttagaattgttatatcttttggctgaaatgatttctttattattggatgatgatctttatccttttttgttacagctttttaatttaaagtctgttttatttgatgtaagtatagatactcctatttacttttggtttctgtttgtgttaatatattcccccccatttgcctttaatctatatgtgtcttacaagtaaggtgagatttttgtaggcaacatagatttgcgttattttttctcattcatttcataaatctatactttttttttttttttgagacggagtcttgctccatcgccaggctggagtgcagtggcgcgatctcgtcccactgctcactgcaacctctgcctcccctattgaagtgattctcctgtctcagcctcctgagtagctgggactacaggcacacaccaccacgctcagctaatttttgtattttcagaagagacggggtttcatcatattcaccaggctggtcttgatctcttgacctcgtgataccctcacctcaccctcccaaagtgctgggactacaggcgtgagccaccgcacccaaccaaatctatacatttcaatgaaggatttaatttatttatattcaaggtaaatattaatatgtaaggttttgttactatcataatgttaattattttcttgtcttattttttctttttatctgtctttgtagtttaataaaattctgtcatgttgtgatttgatttatttcactttgttttgtaagacctgttagttttatacttttatatattttaataatggtgaatatcaatctcttgtttttatattagaattttttttaacatctttcataggcccagtctagtggtaattagtttccccagcatttatttgtcagggtaaga

SEQ ID NO: 311679 - DNA, 362 bp, Homo sapiens
gagaactagtctctctctctctctcttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttt

SEQ ID NO: 311680 - DNA, 3204 bp, Homo sapiens
cgcgccgcagccgcggagggaggggcggggcgggctccggtgtcagcgaccaagccgcaggtggcggcgagcgcggggctcggccgagctcaggagatggggaaactgaggcacggagctggacagtgactcagacaccaggagctgcctggagtggagctgagagctcaggtctgggctcagccagtccagagtgcaaatctactgtcccttcctagctgtgtgatcttgacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttt

SEQ ID NO: 311681 - DNA, 1796 bp, Homo sapiens
agagaggctggctggatgcactcgtgtgtgatgttgcccactttgtccacagggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttt

SEQ ID NO: 311682 - DNA, 1799 bp, Homo sapiens
cctgggcagcaagaggaaactccgtctcaaaaaaaaaaaaaaaaaaaaaaaaaaagcaaataagttagagcatattcgatacttctaagtgctacgaagaaactaaagcagatgacgcgaagacaggaggagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttt

SEQ ID NO: 311683 - DNA, 726 bp, Homo sapiens
accttcgccccgctctgggaggtcttccgcgtctcctcggacaagctggcgctgtgccacctggaactgacacggaagttacaggatctcatcaaggacgttctccgctacggcgaggaacagctcaagacccacaagaaggtgtgtgtcgtgggcgccgcccagcggctgggtgggtgtggaacaccggcagctcacaggaccccagatcttctggggctttataacctgcggatgtccgcctccgagaattccgttaattccacaacgtcaagcccagggtcttacggacctgagcgttgttgaatttcaaacttgcaaaattccagaccaggagttagcacactgtggcccacgggccaaatcccgcccaccccccaccaatgtttgtacagctaagaagggttttttttttttctgcttgtttgtttttaagagacagggtctcactctgtcacccacatgcagtggcgtgatcagagctccctgcagcctcaaacacttgggctcaagcgaacctcctgcctcagcccccacagaatagctgggactacgttgcacgccaccatgcctggctaatttttaaaaaatgtttgggcctggcgtagtgactcatgcctataatcccagcactttgggaggctgaggcaggaggatggctggagcccaggatcctacaggagtttgagaccagcctgggcaacatagggagaccccatctttacc

SEQ ID NO: 311684 - DNA, 739 bp, Homo sapiens
agagaggctggctggatgcactcgtgtgtgatgttgcccactttgtccacagggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggtatgtgagggcggtcctgggcctggctttgggcctcagtg

SEQ ID NO: 311685 - DNA, 3680 bp, Homo sapiens
  misc_feature (3219)..(3219): n is a, c, g, or t
  misc_feature (3224)..(3224): n is a, c, g, or t
  misc_feature (3226)..(3226): n is a, c, g, or t
  misc_feature (3230)..(3230): n is a, c, g, or t
  misc_feature (3237)..(3238): n is a, c, g, or t
  misc_feature (3242)..(3242): n is a, c, g, or t
  misc_feature (3248)..(3248): n is a, c, g, or t
  misc_feature (3251)..(3251): n is a, c, g, or t
  misc_feature (3260)..(3260): n is a, c, g, or t
  misc_feature (3263)..(3263): n is a, c, g, or t
cgcgccgcagccgcggagggaggggcggggcgggctccggtgtcagcgaccaagccgcaggtggcggcgagcgcggggctcggccgagctcaggagatggggaaactgaggcacggagctggacagtgactcagacaccaggagctgcctggagtggagctgagagctcaggtctgggctcagccagtccagagtgcaaatctactgtcccttcctagctgtgtgatcttgacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaacctttaaaaaaaaaacacanaaaananaaanaaaaacnnaaancaacanaanaacagaaanaangaacaacaaaaaaaaaaactcagacccaacaccacacacacaacccacgccagcacacagacgaacaaaaccaacataacaacacaagacacacacacaaccccaccacaacacaccacaccaaacactacctcccccacccaacaatacacactatcctctcacatcacaaaccaaccacaccacacccccccccccgtaaaagacaccaaccacaccaccccacccacacgaccacaacacccaccaaccaacaaacgccacacacaacacctctttcccatacacactctccaagccacactcacacaaacaaaaacaacattcataaccatcaaaaactaaccccaaccccatccccccacaccatatcaatcacccacacaacaacacaacacaccaaatcaccccaccaca

SEQ ID NO: 311686 - DNA, 3114 bp, Homo sapiens
cgcgccgcagccgcggagggaggggcggggcgggctccggtgtcagcgaccaagccgcaggtggcggcgagcgcggggctcggccgagctcaggagatggggaaactgaggcacggagctggacagtgactcagacaccagacaggcactggacggggcctgcaggggtctccacagagaccatcaggatgtcgtattttggggagcatttttggggcgagaaaaatcatggctttgaggtcctgtaccacagcgtgaagcaggggcccatctccaccaaggagctggcggacttcatccgggagagggccaccatcgaggagacctactcgaaggcgatggcgaaactctccaagctggccagcaacgggacccccatggggaccttcgccccgctctgggaggtcttccgcgtctcctcggacaagctggcgctgtgccacctggaactgacacggaagttacaggatctcatcaaggacgttctccgctacggcgaggaacagctcaagacccacaagaagtgcaaggaggaagtggtgagcaccttggatgctgtgcaggtactctcgggcgtcagccagctcctgcccaagtcccgcgagaactacctgaaccgttgcatggaccaggagcggctgcggagggagagtaccagccagaaggagatggacaaggcggagactaaaaccaagaaggcggcagagagcctgcggcgctcagtggaaaaatacaactcagcccgagctgactttgagcagaagatgctggactcagccctgcgcttccaagccatggaggagacacacctgaggcacatgaaggcactgctgggctcatatgctcactcggtggaggacacgcacgtgcagattgggcaggtgcatgaggaatttaagcagaacatcgagaacgtcagcgtggagatgctactcaggaagtttgcagagagtaagggcacaggccgggagaagcctggacctctggacttcgaggcatacagtgcggctgccctgcaggaagcgatgaaacgtttgcggggagccaaggcctttcgccttccaggactaagccggcgggagcgggagccagagccacctgcagctgtagatttcctggagcccgattcagggacatgtccagaggtggatgaagaaggtttcactgtccggcctgatgtgacccagaacagcacggccgagccctcccgtttctcgtccagcgactccgacttcgacgatgaagagccccgcaagttctatgtgcacatcaagcctgccccggcccgggctccagcctgcagccccgaggcagcagcggcacagctcagggccaccgcgggcagcctcatccttcctcctggcccagggggcaccatgaaacgccattcttcacgggacgctgctgggaaaccccagagacctcggtctgcccccagaaccagcagctgtgcagagagattgcagtcagaggagcaggtgtccaagaacctctttgggccgcccctggagtcagcctttgaccacgaagattttacaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttt

SEQ ID NO: 311687 - DNA, 1743 bp, Homo sapiens
atttgtggagagggaagtcaccagaaggtgtagccttgggggcgtgcacaaggactttgaatgggggcccccctgaccttccctcgacgtggccgtggcctgcaggaggatgggcagggactctgagtgggcgagggtcggagctgaccgcccgcttccctccccaaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagacctgatgcctgcacctgctgaccccacagccagggagggcctggcagccccacccaggagacttcgctctaggaaggtgtcctgccctctcacacgtagcaatggggacctgtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttt

SEQ ID NO: 311688 - DNA, 1630 bp, Homo sapiens
atttgtggagagggaagtcaccagaaggtgtagccttgggggcgtgcacaaggactttgaatgggggcccccctgaccttccctcgacgtggccgtggcctgcaggaggatgggcagggactctgagtgggcgagggtcggagctgaccgcccgcttccctccccaaggctctagcagcctgggcttcacctccagcccctcccctttctcctcctcgtcgcccgaaaacgtggaggattccggcctggactctccgtcccacgcggcacctggcccctccccagattcctgggtcccccgcccaggcaccccgcagagcccgcccagctgtagggcgccacccccagaggccaggggtatccgggcaccgcctctgccagactcgccgcagcccctcgcctcgtctccaggcccctgggggctggaggccttggccggaggagtctcgttccctgagcccctccccactgggctcttcagccgccagcactgccttggaacggcccagcttcttatcccagacaggacacggagtctcccggggtccgagccctgtggtcctgggctcccaggatgccctgcccatagccacagccttcacggagtatgtccacgcctacttccgtggccacagccccagctgcctggctcgagtaactggggagctgaccatgaccttccctgctggcatcgtgcgtgtgttcagcgggaccccaccaccacctgtcctcagcttccggcttgtacacacaaccgctattgagcacttccagcccaacgccgatctgctgttcagtgacccctcccagagtgaccctgagaccaaagacttctggctcaacatggcagctctgaccgaagccctgcagcgccaggcagagcagaaccccactgcctcctactacaacgtggtgctgctgcgataccagttctcccgcccgggtccccagtctgtgcctctgcagctcagtgcccactggcagtgtggagccaccctcacccaggtctcagtggagtacggctaccggcccggtgccacggctgtgcccacaccactcacgaacgtccagatcctgctgcctgtgggggagcctgtgaccaacgtccgcttgcagccggctgccacctggaacctggaggagaagcggctcacttggaggcttccagatgtgtccgaggcaggcggttctggccgcctctctgccagctgggagccgctctcagggcccagcacacccagccccgtggctgcacagttcaccagcgaggggaccactctgtcgggcgtggacttggaactggtgggcagcggttaccgcatgtcgctggtgaagaggaggtttgccacagggatgtacctggtgagctgctgaacccgcaaatgctgctgccccagctctacactgcgccctggtgctggctgaccaccccctgccctcctgccggaccctggggcctcccaccccagcctccctgaggcccatactccacggagaggagccccatgcccagcctggctgagcccgagattcgctcctccccctcatgccaaccccacacaggtcccggccttttaatgttctttgaataaacactttattttctaataaaataaaaaaggaaaccttt

SEQ ID NO: 311689 - DNA, 1180 bp, Homo sapiens
tatcagccccctgggactccctggccccaacctgccacctcaccaaagctctgagccctgctagccttgaggcgcggaccctcccccatacctcccacagtatcccagcgcctcatgcccccaaccccaagccctgcccttcaccgcccggctgcactggcctctaggactcacagcagccagccccagctaggaacgggcaggacttggggcagctgaagctcacggtgactcagcagtgcccaactgaccaatctcccgcagctctcctgcccctgggggcccacgactcacctggtgggcctgggctcagcaaacagccctccctcccagtatttcatcaaggacagggaatatccctcccacacacaggccagctgctcaccctgccacctccatgtgacaagtttgacacctgtctacccagagccagtgactgtccctcccagcagcctccaaagggtccaaagtccaagctagctctggcctgtgtggcccccacataaataaattagtggggagggggcagacctgggggcccttgggtgccagagtgagacacagcaggacccttccccaaatactaggctcagagcaacctccagccttctccagcaggatctgctccctgtgtccttggacagcagatccacacaccacttccccacccacacacagtaccctgggctggttggacaacaggatggtgtgttaaggggttaagggagggtactgttgacaccagctatggccaatagctgggctgtcctgaggggtggctggggacagagtccagctcccttggatcagcccagaggattcaggataggacaaaggccctggctgtgcccaaaagggtctacctcaggtggggttacaagcaaacctgggtgaccctcttgtccctaccagcagcttctcttgccccttccattcagggttccctggcaggggaagctgagagccatggctgaactatcagggacaaaggcccatgtccccacatccctgctccctccttcctcatccagcaccaaatctttgcttatgttccacagccagggcctgtgctgcagtcggggacaaggagcttccgtctggcaaggccggggcacaatttgcactcccctcagctagacgcacagactcagcaataaacctttgcatcaggctccagctg

SEQ ID NO: 311690 - DNA, 1218 bp, Homo sapiens
  misc_feature (8)..(8): n is a, c, g, or t
  misc_feature (14)..(14): n is a, c, g, or t
  misc_feature (90)..(90): n is a, c, g, or t
  misc_feature (149)..(149): n is a, c, g, or t
  misc_feature (171)..(172): n is a, c, g, or t
  misc_feature (190)..(190): n is a, c, g, or t
  misc_feature (353)..(353): n is a, c, g, or t
  misc_feature (362)..(362): n is a, c, g, or t
  misc_feature (382)..(382): n is a, c, g, or t
  misc_feature (389)..(389): n is a, c, g, or t
aaaaaaanatggcnccaacttcccctcccgggggacccttgaagggagggcaaaaaaaactcctggtagggcaaagagggtcacccaggnttgttttaaccccaccttgaggaaaacccctttgggcacaaccagggcctttgtcctanccttgaatcccctgggcctganncaagggagctggactctntccccaaccaccccctcaggacagcccagctattggccatagctggtgttaacagtaccctcccttaaccccttaacacaccatcctgttgtccaaccaacccagggtactgtgtgtgggtggggaagtggtgtgtggatctgctgtccaaggacacagggancagatcctnctggagaaggctggaggttnctctgancctagtatttggggaagggtcctgctctgctcaccctgccacctccatgtgacaagtttgacacctgtctacccagagccagtgactgtccctcccagcagcctccaaagggtccaaagtccaagctagctctggcctgtgtggcccccacataaataaattagtggggagggggcagacctgggggcccttgggtgccagagtgagacacagcaggacccttccccaaatactaggctcagagcaacctccagccttctccagcaggatctgctccctgtgtccttggacagcagatccacacaccacttccccacccacacacagtaccctgggctggttggacaacaggatggtgtgttaaggggttaagggagggtactgttgacaccagctatggccaatagctgggctgtcctgaggggtggctggggacagagtccagctcccttggatcagcccagaggattcaggataggacaaaggccctggctgtgcccaaaagggtctacctcaggtggggttacaagcaaacctgggtgaccctcttgtccctaccagcagcttctcttgccccttccattcagggttccctggcaggggaagctgagagccatggctgaactatcagggacaaaggcccatgtccccacatccctgctccctccttcctcatccagcaccaaatctttgcttatgttccacagccagggcctgtgctgcagtcggggacaaggagcttccgtctggcaaggccggggcacaatttgcactcccctcagctagacgcacagactcagcaataaacctttgcatcaggctccagctg

SEQ ID NO: 311691 - DNA, 785 bp, Homo sapiens
  misc_feature (714)..(714): n is a, c, g, or t
  misc_feature (748)..(748): n is a, c, g, or t
  misc_feature (766)..(766): n is a, c, g, or t
gagagccagttgattgcaggtcctcctggggccagaagggtgcctgggaggccaggttctggggatcccctccatccagaagaaccacctgctcactctgtcccttcgcctgctgctgggaccatgggggctggggccagtgctgaggagaagcactccagggagctggaaaagaagctgaaagaggacgctgagaaggatgctcgaaccgtgaagctgctgcttctgggtgccggtgagtccgggaagagcaccatcgtcaagcagatgaagattatccaccaggacgggtactcgctggaagagtgcctcgagtttatcgccatcatctacggcaacacgttgcagtccatcctggccatcgtacgcgccatgaccacactcaacatccagtacggagactctgcacgccaggacgacgcccggaagctgatgcacatggcagacactatcgaggagggcacgatgcccaaggagatgtcggacatcatccagcggctgtggaaggactccggtatccaggcctgttttgagcgcgcctcggagtaccagctcaacgactcggcgggctactacctctccgacctggagcgcctggtaaccccgggctacgtgcccaccgagcaggacgtgctgcgctcgcgagtcaagaccactggcatcatcgagacgcagttctccttcaaggatctcaacttccggttgttcgatgtngggggcagcctcggagcgaagaagtggtccactnttcgagggtactgatatntcacggggggtgggcttca

SEQ ID NO: 311692 - DNA, 1385 bp, Homo sapiens
caaaagagctaattccctctgagcctcctggagacacctgcaccccttcaggtgaaatgcaaggggtttacccgcctcaaataacccagtgcttgcggtaccagaggctcccacgaggtggcgatgacgctccgggatttcttcattgcagtctcacagcataataaaggctgcctgtgccggggtcttggggactcccctgtcccagaacagttgaggtcgttgagtcccctcgttggcttcctttcttcactttcctggcatttgcaaaccttgtgacttcaggatgtcaggacttaatttggatgggggggtgccggtgagtccgggaagagcaccatcgtcaagcagatgaagattatccaccaggacgggtactcgctggaagagtgcctcgagtttatcgccatcatctacggcaacacgttgcagtccatcctggccatcgtacgcgccatgaccacactcaacatccagtacggagactctgcacgccaggacgacgcccggaagctgatgcacatggcagacactatcgaggagggcacgatgcccaaggagatgtcggacatcatccagcggctgtggaaggactccggtatccaggcctgttttgagcgcgcctcggagtaccagctcaacgactcggcgggctactacctctccgacctggagcgcctggtaaccccgggctacgtgcccaccgagcaggacgtgctgcgctcgcgagtcaagaccactggcatcatcgagacgcagttctccttcaaggatctcaacttccggatgttcgatgtgggcgggcagcgctcggagcccaagaagtggatccactgcttcgagggcgtgacctgcatcatcttcatcgcggcgctgaccgcgtacgacatggtgctagtggaggacgacgaagtgaaccgcatgcacgagagcctgcacctgttcaacagcatctgcaaccaccgctacttcgccacgacgtccatcgtgctcttccttaacaagaaggacgtcttcttcgagaaggtcaagaaggcgcacctcagcatctgtttcccggactacgatggacccaacacctacgaggacgccggcaactacatcaaggtgcagttcctcgagctcaacatgcggcgcgacgtgaaggagatctattcccacatgacgtgcgccaccgacacgcagaacgtcaaattctgtcttcgacgctgtcaccgacatcatcatcaaggagaacctcaaagactgtggcctcttctgaggccagggcctgtgctgcagtcggggacaaggagcttccgtctggcaaggccggggcacaatttgcactcccctcagctagacgcacagactcagcaataaacctttgcatcaggctccagctg

SEQ ID NO: 311693 - DNA, 1301 bp, Homo sapiens
gagagccagttgattgcaggtcctcctggggccagaagggtgcctgggaggccaggttctggggatcccctccatccagaagaaccacctgctcactctgtcccttcgcctgctgctgggaccatgggggctggggccagtgctgaggagaagcactccagggagctggaaaagaagctgaaagaggacgctgagaaggatgctcgaaccgtgaagctgctgcttctgggtgccggtgagtccgggaagagcaccatcgtcaagcagatgaagattatccaccaggacgggtactcgctggaagagtgcctcgagtttatcgccatcatctacggcaacacgttgcagtccatcctggccatcgtacgcgccatgaccacactcaacatccagtacggagactctgcacgccaggacgacgcccggaagctgatgcacatggcagacactatcgaggagggcacgatgcccaaggagatgtcggacatcatccagcggctgtggaaggactccggtatccaggcctgttttgagcgcgcctcggagtaccagctcaacgactcggcgggctactacctctccgacctggagcgcctggtaaccccgggctacgtgcccaccgagcaggacgtgctgcgctcgcgagtcaagaccactggcatcatcgagacgcagttctccttcaaggatctcaacttccggatgttcgatgtgggcgggcagcgctcggagcccaagaagtggatccactgcttcgagggcgtgacctgcatcatcttcatcgcggcgctgaccgcgtacgacatggtgctagtggaggacgacgaagtgaaccgcatgcacgagagcctgcacctgttcaacagcatctgcaaccaccgctacttcgccacgacgtccatcgtgctcttccttaacaagaaggacgtcttcttcgagaaggtcaagaaggcgcacctcagcatctgtttcccggactacgatggacccaacacctacgaggacgccggcaactacatcaaggtgcagttcctcgagctcaacatgcggcgcgacgtgaaggagatctattcccacatgacgtgcgccaccgacacgcagaacgtcaaattctgtcttcgacgctgtcaccgacatcatcatcaaggagaacctcaaagactgtggcctcttctgaggccagggcctgtgctgcagtcggggacaaggagcttccgtctggcaaggccggggcacaatttgcactcccctcagctagacgcacagactcagcaataaacctttgcatcaggctccagctg

SEQ ID NO: 311694 - DNA, 1123 bp, Homo sapiens
caaaagagctaattccctctgagcctcctggagacacctgcaccccttcaggtgccggtgagtccgggaagagcaccatcgtcaagcagatgaagattatccaccaggacgggtactcgctggaagagtgcctcgagtttatcgccatcatctacggcaacacgttgcagtccatcctggccatcgtacgcgccatgaccacactcaacatccagtacggagactctgcacgccaggacgacgcccggaagctgatgcacatggcagacactatcgaggagggcacgatgcccaaggagatgtcggacatcatccagcggctgtggaaggactccggtatccaggcctgttttgagcgcgcctcggagtaccagctcaacgactcggcgggctactacctctccgacctggagcgcctggtaaccccgggctacgtgcccaccgagcaggacgtgctgcgctcgcgagtcaagaccactggcatcatcgagacgcagttctccttcaaggatctcaacttccggatgttcgatgtgggcgggcagcgctcggagcccaagaagtggatccactgcttcgagggcgtgacctgcatcatcttcatcgcggcgctgaccgcgtacgacatggtgctagtggaggacgacgaagtgaaccgcatgcacgagagcctgcacctgttcaacagcatctgcaaccaccgctacttcgccacgacgtccatcgtgctcttccttaacaagaaggacgtcttcttcgagaaggtcaagaaggcgcacctcagcatctgtttcccggactacgatggacccaacacctacgaggacgccggcaactacatcaaggtgcagttcctcgagctcaacatgcggcgcgacgtgaaggagatctattcccacatgacgtgcgccaccgacacgcagaacgtcaaattctgtcttcgacgctgtcaccgacatcatcatcaaggagaacctcaaagactgtggcctcttctgaggccagggcctgtgctgcagtcggggacaaggagcttccgtctggcaaggccggggcacaatttgcactcccctcagctagacgcacagactcagcaataaacctttgcatcaggctccagctg

SEQ ID NO: 311695 - DNA, 2425 bp, Homo sapiens
  misc_feature (1)..(1): n is a, c, g, or t
  misc_feature (5)..(5): n is a, c, g, or t
ngagngggcggcggcggcagcagacccctctccagggagtccaggacctgccagcgctggggattcttcccgaacaggcgcttgccctctcttttatggagcttgggcccctgccgcagcccggtagaggctgtggaggtctaccgtccggaagcctggttcccagccccgtggcccattcctggctacggggagtggaggctcccacgaggtagcggtggcctgcagcggcctcctccccgcagtgaagcatgggccagaagctctcggggagcctcaagtcagtggaggtgcgagagccggcgctgcggccggccaagcgggagctgcggggtgcagagcccgggcggccggcgcggctggaccagctgttggacatgccagcggcggggctggctgtgcagctgcggcacgcgtggaaccccgaggaccgctcgctcaacgtcttcgtcaaggacgacgaccggctcaccttccaccggcaccccgtggcccagagcaccgacggcatccgcggcaaggtgggccacgcccgcggcctgcacgcctggcagatcaactggccggctcggcagcgcggcacccacgctgtagttggtgtggccacggcccgtgctcccctgcactccgtgggctacacggcgctggtaggcagtgacgccgagtcgtggggctgggacctgggccgcagccgcctctaccacgacggcaagaaccagcccggcgtggcctacccggcctttctggggcccgacgaggcctttgcgctgcccgactcgctgctcgtggtgctggacatggatgagggcacactcagcttcatcgtggatggccagtacctgggcgtggccttccgaggtctcaagggcaagaagctgtacccggtggtgagtgccgtgtggggccactgtgaagtcaccatgcgctacatcaacggccttgaccccgagcccctgccactgatggacctgtgccggagatccatccgctcggccctgggccgccagcgcctgcaggacatcagctccctgcccctgcctcagtctctcaaaaactatctgcagtaccagtgagccaagcctgatgggcagcacagacacagacacacaccgcagggcccgaccctcctgtcattcacagtcccatggcacataggggaaaggatctacccttctcctggctccccaggacactcagttctttcaaagaccaggatgtggtaccaactttggaaacgaaaggtctcttgccaacagtatctactgccctcgaggcagccctcccaagtcagacacctccttcggagccacagagagcctggagtctgcacctcctggaaatcctgccaccaaccaggacacagcagccaccgtattgatcagagagcctgtttccttattcaagagaatgaataaaacatttaggcaggagactttctattgtgtgccccgttgcagacagggccagggagaaattagccagtgcagggggaaaattgcctctgaataatgaatgatgaaagcctgacgccgtgcccctcctggcccatacgccttgccagggcggcaggattgtcacaccgttttaggactctgtgccactttgagagactgttcccaggaggcccaaccgcagacctggcaagtggacagtgcagtgtggagacaccttccggcttacctctttgaacgttgtttacctacccctttccacgtgctccccttcccagccactgactcacagttctctggatgcccagacacctctcttcagggaagatgagtctgactggtttgccccagggaagagcgtatccttaccattattttaagtagcatttgcattttaaaagaggaatgcggagaggacagtacttagtccaaaggtgctaacgggggaactgggggcattgtgacacccaagtctgatgtgtcctgggttggggggccttcctggagtgtcagggtctctgggcaacgtccattcagggtgcggcatggctgtcacaaagctttatttgagcaaattattttttcactttaggagacttctacaagtttgtttcctgtttcaaatgtgtgtgtgatgtgctgtttatttatcagcttgaggtccatgggggcagccttgtgactggaagggtggatatgggagacacattctctacctgctccgagcctggtcctctcgcaggaatgctgctgctgcctccgccgccactgctgctgccacctcttatatgtttcagacactctctgcccagactcatttttaactggaaatcatcacagcagtgggatatcagagccccagacagcactgcctcttcctccccaccccactgcccccaccttaatgtgaatttgactgatgaatgaagagcgtttctaataaagtttgtcattcagtccttcaaaaaaaaaaa

SEQ ID NO: 311696 - DNA, 3202 bp, Homo sapiens
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcaggcagttcctgtggagcttccggctgccgggcgaggcccagaagatagaccggatgatggaggcctttgccactcgatactgcctctgcaacccaggcgtcttccagtccacagacacctgctacgtgttgtccttctccatcatcatgctcaacaccagcctccacaatcccaacgtccgggacaggccgcctttcgagcgctttgtgtccatgaaccgcggcatcaacaatggtagcgacctgcccgaggaccagctgcggaacctcttcgacagcatcaagagtgagccattctccatccctgaggacgacggcaatgacctcactcacaccttcttcaatccagaccgggagggttggctgctcaagctagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcactgggggctggtcaccctgagagtcccatcgcctgcagcacctggagacccacctcccaccccagtgcactcttttgggccacagacatcattgctgttccccgttacctcgagctgactctagaggggaaggcagagctcaggagggtgggtgggagctgcagtgggctcagagtccagcaatgaggccccctggcctgggcacccagctgcaggcccctgccctacgtgcactacaggaaggggtgaggagagcagccagaggaaaaccagccccagaatgctgcaacttctcttctctctggacttcggtgtcctcggctctgaaggcgctctctgcacttagatgctgtcagccctcaacgtaggaggggccgtggggtccctaagtgattcttctccctggcaaggctcttccttttcagggatatctctgccaacccctcccctgtcctcgggttgggcttggccctctctgcctgagagagctcagcacacacacagctcagacccacggacaggaccccgggacagaaccccgggagcactgccctaggagcccggaccccacgagctcagtcccagctctgcctctgactcgctgtgtaccctctgccaagtcatgcccattctctagttcttgcaaaactgcagtgtttggactagaaacgtattggcccctgctagccctgtgctccagcttccagctggagatggcagccgttatttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggccgcctggaggcagtggctgagccagaaagtaacacagagctcatgcttggagagatagagtcttggccatggctttcctgcaagaccactgacgagcagtcccatggtgataaagggcagcccggcgggtcccagcatctcgagaccctctgcagaagtattatcagagtagagctgacttccagtacccgggcagccagctctgtctccagggaggcctggcctggaggaggagtccactaacaggaaacacttctcaccccctcacacaggcccaggggagcccctggagggaaattccttggcaggggaacaggaaatgtggtcgcctctgccccactgccagcctgagtgggcaaggaagcaggtggatcccccagaaggaaccgcagctcgcgaggcacctctcctcgtccccacccacccccacatttgcacaccttccacagggtcaggatggagtagctgccttgcgaggtggtgagactcctgtctctggaggtctgcaagcactggtagtgatattgcagcagacaaggtctgggttgggcgtctgcaggaggagaccttgtgggacatctgaggacatccgcagattcttgtcagcctgtgaactaggccctgcctctgtcacctcattggtccatgaaggagcagccaggggtggtggaaggagcactgggctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaa

SEQ ID NO: 311697 - DNA, 1248 bp, Homo sapiens
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagaggtaagaacgagtggagccttagcgaggcaggaaatgaaggtgtgcaggtgtgtacaggtgtgtggatgtgcaggtgagaggatgaattatgttagcaaagtcatcactcctagtgcttgaggggctcacggatcatcccctccagattctgagtcaaagcctgactgccttcattcatttagtcatttattcaacaaataaatgttgctcagggtctactgtgttccaggcaccatcctaagccctgggtgtacaccagtgaataagacagacaaaactcttgtcctcaggaagtccatgctagtgggagagacaggtctcaatagttgtaaaatatgttagagaatgataagctctgtggaatacaaatcgagcagggaagggaagtcagaaatgctggggaccggccaggctcggggctcatgcctgtaatcccagcactttgggaggccgaggcaggcagatcgcgaggtcaggagttccagatcagcctagccaacgtggtgaaaccccgtctctactaaaaatacaaaaattagccggatgtggtggcaggtgcctgtagtcccagttactcaggaggctgaagcaggggaatcgcttgagcctgggagtcggaggttgtagtgagccaagatcacgccattgcactccagcctgggcaacagattgagaacgagactccgtctcaaaaaaaaaaagaaaaga

SEQ ID NO: 311698 - DNA, 3709 bp, Homo sapiens
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcaggcagttcctgtggagcttccggctgccgggcgaggcccagaagatagaccggatgatggaggcctttgccactcgatactgcctctgcaacccaggcgtcttccagtccacagacacctgctacgtgttgtccttctccatcatcatgctcaacaccagcctccacaatcccaacgtccgggacaggccgcctttcgagcgctttgtgtccatgaaccgcggcatcaacaatggtagcgacctgcccgaggaccagctgcggaacctcttcgacagcatcaagagtgagccattctccatccctgaggacgacggcaatgacctcactcacaccttcttcaatccagaccgggagggttggctgctcaagctagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcacccagtgcactcttttgggccacagacatcattgctgttccccgttacctcgagctgactctagaggggaaggcagagctcaggagggtgggtgggagctgcagtgggctcagagtccagcaatgaggccccctggcctgggcacccagctgcaggcccctgccctacgtgcactacaggaaggggtgaggagagcagccagaggaaaaccagccccagaatgctgcaacttctcttctctctggacttcggtgtcctcggctctgaaggcgctctctgcacttagatgctgtcagccctcaacgtaggaggggccgtggggtccctaagtgattcttctccctggcaaggctcttccttttcagggatatctctgccaacccctcccctgtcctcgggttgggcttggccctctctgcctgagagagctcagcacacacacagctcagacccacggacaggaccccgggacagaaccccgggagcactgccctaggagcccggaccccacgagctcagtcccagctctgcctctgactcgctgtgtaccctctgccaagtcatgcccattctctagttcttgcaaaactgcagtgtttggactagaaacgtattggcccctgctagccctgtgctccagcttccagctggagatggcagccgttatttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggccgcctggaggcagtggctgagccagaaagtaacacagagctcatgcttggagagatagagtcttggccatggctttcctgcaagaccactgacgagcagtcccatggtgataaagggcagcccggcgggtcccagcatctcgagaccctctgcagaagtattatcagagtagagctgacttccagtacccgggcagccagctctgtctccagggaggcctggcctggaggaggagtccactaacaggaaacacttctcaccccctcacacaggcccaggggagcccctggagggaaattccttggcaggggaacaggaaatgtggtcgcctctgccccactgccagcctgagtgggcaaggaagcaggtggatcccccagaaggaaccgcagctcgcgaggcacctctcctcgtccccacccacccccacatttgcacaccttccacagggtcaggatggagtagctgccttgcgaggtggtgagactcctgtctctggaggtctgcaagcactggtagtgatattgcagcagacaaggtctgggttgggcgtctgcaggaggagaccttgtgggacatctgaggacatccgcagattcttgtcagcctgtgaactaggccctgcctctgtcacctcattggtccatgaaggagcagccaggggtggtggaaggagcactgggctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaaaaaaaaaaaaaagaaagaaaaaagcaaaaaaaaaaacaacaaaaaaaaacaaagagaagcaacaaaataacatacaaaaaaagaaaaggaggggggcgggggcggcactataaataaccgccgccgcgggaggggcccagaatgttgagcagctgcaccgcacgattttcgttgagcgagggggcccccatagtggagggggtgcattatattatcagggcgagaggcgcgcggcggcgcgtgtaaaaaaaacgagtgcttggtggtggagaaaacaacgcttgcattggttgggggtactcattggtgtggagaaagagaccaccatctatctgcggggggggggcaaaccaatgggtggagcacacaccaccccacgagaggaaatttagagaggctgctgccccgagggggggagataattatcaaaaacatgtgtacggagggtttactaagtggtgtgttaaaccaccacagcgtcatatattagtgcgtggcgcacggaaaaaaaagtttgtgcccaccaggggaattattagtttgagaaagaaattctttaccggcggg

SEQ ID NO: 311699 - DNA, 2144 bp, Homo sapiens
tagcgtctgggcttctctgagcctcctggagggcccacccagcctccctctcttcccacccttgcctggccacctccccacagttcttctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcactgggggctggtcaccctgagagtcccatcgcctgcagcacctggagacccacctcccaccccagtgcactcttttgggccacagacatcattgctgttccccgttacctcgagctgactctagaggggaaggcagagctcaggagggtgggtgggagctgcagtgggctcagagtccagcaatgaggccccctggcctgggcacccagctgcaggcccctgccctacgtgcactacaggaaggggtgaggagagcagccagaggaaaaccagccccagaatgctgcaacttctcttctctctggacttcggtgtcctcggctctgaaggcgctctctgcacttagatgctgtcagccctcaacgtaggaggggccgtggggtccctaagtgattcttctccctggcaaggctcttccttttcagggatatctctgccaacccctcccctgtcctcgggttgggcttggccctctctgcctgagagagctcagcacacacacagctcagacccacggacaggaccccgggacagaaccccgggagcactgccctaggagcccggaccccacgagctcagtcccagctctgcctctgactcgctgtgtaccctctgccaagtcatgcccattctctagttcttgcaaaactgcagtgtttggactagaaacgtattggcccctgctagccctgtgctccagcttccagctggagatggcagccgttatttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggccgcctggaggcagtggctgagccagaaagtaacacagagctcatgcttggagagatagagtcttggccatggctttcctgcaagaccactgacgagcagtcccatggtgataaagggcagcccggcgggtcccagcatctcgagaccctctgcagaagtattatcagagtagagctgacttccagtacccgggcagccagctctgtctccagggaggcctggcctggaggaggagtccactaacaggaaacacttctcaccccctcacacaggcccaggggagcccctggagggaaattccttggcaggggaacaggaaatgtggtcgcctctgccccactgccagcctgagtgggcaaggaagcaggtggatcccccagaaggaaccgcagctcgcgaggcacctctcctcgtccccacccacccccacatttgcacaccttccacagggtcaggatggagtagctgccttgcgaggtggtgagactcctgtctctggaggtctgcaagcactggtagtgatattgcagcagacaaggtctgggttgggcgtctgcaggaggagaccttgtgggacatctgaggacatccgcagattcttgtcagcctgtgaactaggccctgcctctgtcacctcattggtccatgaaggagcagccaggggtggtggaaggagcactgggctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaa

SEQ ID NO: 311700 - DNA, 2126 bp, Homo sapiens
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcaggcagttcctgtggagcttccggctgccgggcgaggcccagaagatagaccggatgatggaggcctttgccactcgatactgcctctgcaacccaggcgtcttccagtccacagacacctgctacgtgttgtccttctccatcatcatgctcaacaccagcctccacaatcccaacgtccgggacaggccgcctttcgagcgctttgtgtccatgaaccgcggcatcaacaatggtagcgacctgcccgaggaccagctgcggaacctcttcgacagcatcaagagtgagccattctccatccctgaggacgacggcaatgacctcactcacaccttcttcaatccagaccgggagggttggctgctcaagctagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcactgggggctggtcaccctgagagtcccatcgcctgcagcacctggagacccacctcccaccccagtgcactcttttgggccacagacatcattgctgttccccgttacctcgagctgactctagaggggaaggcagagctcaggagggtgggtgggagctgcagtgggctcagagtccagcaatgaggccccctggcctgggcacccagctgcaggcccctgccctacgtgcactacaggaaggggtgaggagagcagccagaggaaaaccagccccagaatgctgcaacttctcttctctctggacttcggtgtcctcggctctgaaggcgctctctgcacttagatgctgtcagccctcaacgtaggaggggccgtggggtccctaagtgattcttctccctggcaaggctcttccttttcagggatatctctgccaacccctcccctgtcctcgggttgggcttggccctctctgcctgagagagctcagcacacacacagctcagacccacggacaggaccccgggacagaaccccgggagcactgcctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaa

SEQ ID NO: 311701 - DNA, 351 bp, Homo sapiens
  misc_feature (40)..(40): n is a, c, g, or t
attaccgaattcgagcgtcggtatccccagaggcaccaanggaggagaccttgtgggacatctgaggacatccgcagattcttgtcagcctgtgaactaggccctgcctctgtcacctcattggtccatgaaggagcagccaggggtggtggaaggagcactgggctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaa

SEQ ID NO: 311702 - DNA, 983 bp, Homo sapiens
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcagattccgagaaggagcatctgatctgggctttggagggtgagtaggagttcacaatacagagaaggaagaagccaccaccatccagtgttctctaactcccagctctttaagggagaggggtagccaggactgtgtgaagcccaggaggagaagtgagagatacaggcccagttctcaccttcagagaacttagcttgaagctgtcgaaaccaccaacttccagagctagagggaagtcgaggttccaagaaagggagccctagcaaggcaaaacccctgccccacctcttccccaactaggtcccacagccagatctcagggcccaaaggccaggtgcggggagccacagaccccggggcag

SEQ ID NO: 311703 - DNA, 417 bp, Homo sapiens
acactagcgtctgggcttctctgagcctcctggagggcccacccagcctccctctcttcccacccttgcctggccacctccccacagttcttctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccggtaaggggtgcccaggtctggggacggcttcccgtcaccttccagaaggccctgcttcttttgggtcttgcttccttatctgtaaaggggctaactccagtctctccctcctgtttctggctggcaaaccccttccacccgtattccatgggtactttctgtgtgcctggca

SEQ ID NO: 311704 - DNA, 454 bp, Homo sapiens
aggcagctcctatgaaagaggggtcaaaacttcccagaacagactgtgccaacaccagaatgccaggctccaggattctggccatggaagctccttcctcccttccccctcccaggcctgcttccatgcagcagctgctcacggcttctgtgtaccccctccagggtatccagtatttcattgagcacaagctgctgacccctgacgtccaggacattgcacggttcctgtataaaggcgagggcctcaacaagacagccattggtacctacctgggggagaggtaagaacgagtggagccttagcgaggcaggaaatgaaggtgtgcaggtgtgtacaggtgtgtggatgtgcaggtgagaggatgaattatgttagcaaagtcatcactcctagtgcttgaggggctcacggatcatcccctccagattctgagtcaaagcctgactgcctt

SEQ ID NO: 311705 - DNA, 4619 bp, Homo sapiens
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcaggcagttcctgtggagcttccggctgccgggcgaggcccagaagatagaccggatgatggaggcctttgccactcgatactgcctctgcaacccaggcgtcttccagtccacagacacctgctacgtgttgtccttctccatcatcatgctcaacaccagcctccacaatcccaacgtccgggacaggccgcctttcgagcgctttgtgtccatgaaccgcggcatcaacaatggtagcgacctgcccgaggaccagctgcgggttacatgggagtgctcccagaggagaagccgggaaaggacatttcaaaaagaagaagtggccagaacggaggcgtgtcctgattgggaaaggagaggtgtccagtgtggccgagaacctcttcgacagcatcaagagtgagccattctccatccctgaggacgacggcaatgacctcactcacaccttcttcaatccagaccgggagggttggctgctcaagctaggtgagagaccgacagacacacgtcgtcgcacacacactcatgcacgcgcgggcacacatcgttgcatgcacactcctggacgcacaggcccccagctgacacgaggctcacatgcatcctgggggatggagttggacagccccaggtctcctggcccccagtgcagccgtctgcctgccccatccatccacctgtcccgagaaggaagggagccagtggtgggggctgagctgtaagccgggcgagaggcagacagacccactgacaaatgcttcagctgcggttctgtttctctctccccagcggaatggggagggaagtcatagcaggaagtaccatttgttcagaacctactgagctcaggcaaggtgctggtccaccctacagccgaacagtaaagtcagggatctgcctgaggccacacagccagccaggggcagatttgagggcacagagggttaggtgtccctaaaggaggggaggaaggatgacaggatgtggcttagggggaggctcccttcaagctgactgggggcagggagggcctgcaccctgcagagagcagctggggtgggagctgcagtaatagtggctgtagagtccagcagggcaaccccagtgcccggccgtctgcccctgcctcccacacacacttccggaagcctctccagcagggacagccaagccggggacagcgcctccagggcaggtgaggacagatgcctcatgttgaagcaggggtctcaacctggctcacctccagcaacattgagcctccagcacctcctgtctaccaagccccgtgccagtcctgcccagaacccccaggagcccatgagccctctgactctccacaccacaccccagtccatcctcctccagagcactcggccgcctgtcctgccccagccacgtgctgtccgcccccgagaagctctatgtcataaatcttaactcagatgggagagggagcctcagagtcacatagccctgggcccaaaccccagctcctccacccaagtactgatggtcaggttcttcagcctcagtttctgtagctgtaagatggggagaatgatctctgggagggttaaatgtgcggcaaaatggccaagagttgggctctgggactaggacattggggttcgaatcccagctctgctgctgaaccgtgggcaggcgattttacctctccatgactgtttcctcatctgtaaaatggggttaacaatggtctcctcttcatacgtggttgtgaggattaataagtaatattttttgaaacctctagagcagtgtctggcaaatgaaggacgaaatgcttagcattgtgccaggcagggaccaagctaaggaatgaagcaatggatggcggtagccaggaagagcaggaactggccattcctaggaccattcctaggacctgatcacggaggccacccaaacgccagttctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcactgggggctggtcaccctgagagtcccatcgcctgcagcacctggagacccacctcccaccccagtgcactcttttgggccacagacatcattgctgttccccgttacctcgagctgactctagaggggaaggcagagctcaggagggtgggtgggagctgcagtgggctcagagtccagcaatgaggccccctggcctgggcacccagctgcaggcccctgccctacgtgcactacaggaaggggtgaggagagcagccagaggaaaaccagccccagaatgctgcaacttctcttctctctggacttcggtgtcctcggctctgaaggcgctctctgcacttagatgctgtcagccctcaacgtaggaggggccgtggggtccctaagtgattcttctccctggcaaggctcttccttttcagggatatctctgccaacccctcccctgtcctcgggttgggcttggccctctctgcctgagagagctcagcacacacacagctcagacccacggacaggaccccgggacagaaccccgggagcactgccctaggagcccggaccccacgagctcagtcccagctctgcctctgactcgctgtgtaccctctgccaagtcatgcccattctctagttcttgcaaaactgcagtgtttggactagaaacgtattggcccctgctagccctgtgctccagcttccagctggagatggcagccgttatttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggccgcctggaggcagtggctgagccagaaagtaacacagagctcatgcttggagagatagagtcttggccatggctttcctgcaagaccactgacgagcagtcccatggtgataaagggcagcccggcgggtcccagcatctcgagaccctctgcagaagtattatcagagtagagctgacttccagtacccgggcagccagctctgtctccagggaggcctggcctggaggaggagtccactaacaggaaacacttctcaccccctcacacaggcccaggggagcccctggagggaaattccttggcaggggaacaggaaatgtggtcgcctctgccccactgccagcctgagtgggcaaggaagcaggtggatcccccagaaggaaccgcagctcgcgaggcacctctcctcgtccccacccacccccacatttgcacaccttccacagggtcaggatggagtagctgccttgcgaggtggtgagactcctgtctctggaggtctgcaagcactggtagtgatattgcagcagacaaggtctgggttgggcgtctgcaggaggagaccttgtgggacatctgaggacatccgcagattcttgtcagcctgtgaactaggccctgcctctgtcacctcattggtccatgaaggagcagccaggggtggtggaaggagcactgggctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaa

SEQ ID NO: 311706 - DNA, 3142 bp, Homo sapiens
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcaggcagttcctgtggagcttccggctgccgggcgaggcccagaagatagaccggatgatggaggcctttgccactcgatactgcctctgcaacccaggcgtcttccagtccacagacacctgctacgtgttgtccttctccatcatcatgctcaacaccagcctccacaatcccaacgtccgggacaggccgcctttcgagcgctttgtgtccatgaaccgcggcatcaacaatggtagcgacctgcccgaggaccagctgcggaacctcttcgacagcatcaagagtgagccattctccatccctgaggacgacggcaatgacctcactcacaccttcttcaatccagaccgggagggttggctgctcaagctagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcacccagtgcactcttttgggccacagacatcattgctgttccccgttacctcgagctgactctagaggggaaggcagagctcaggagggtgggtgggagctgcagtgggctcagagtccagcaatgaggccccctggcctgggcacccagctgcaggcccctgccctacgtgcactacaggaaggggtgaggagagcagccagaggaaaaccagccccagaatgctgcaacttctcttctctctggacttcggtgtcctcggctctgaaggcgctctctgcacttagatgctgtcagccctcaacgtaggaggggccgtggggtccctaagtgattcttctccctggcaaggctcttccttttcagggatatctctgccaacccctcccctgtcctcgggttgggcttggccctctctgcctgagagagctcagcacacacacagctcagacccacggacaggaccccgggacagaaccccgggagcactgccctaggagcccggaccccacgagctcagtcccagctctgcctctgactcgctgtgtaccctctgccaagtcatgcccattctctagttcttgcaaaactgcagtgtttggactagaaacgtattggcccctgctagccctgtgctccagcttccagctggagatggcagccgttatttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggccgcctggaggcagtggctgagccagaaagtaacacagagctcatgcttggagagatagagtcttggccatggctttcctgcaagaccactgacgagcagtcccatggtgataaagggcagcccggcgggtcccagcatctcgagaccctctgcagaagtattatcagagtagagctgacttccagtacccgggcagccagctctgtctccagggaggcctggcctggaggaggagtccactaacaggaaacacttctcaccccctcacacaggcccaggggagcccctggagggaaattccttggcaggggaacaggaaatgtggtcgcctctgccccactgccagcctgagtgggcaaggaagcaggtggatcccccagaaggaaccgcagctcgcgaggcacctctcctcgtccccacccacccccacatttgcacaccttccacagggtcaggatggagtagctgccttgcgaggtggtgagactcctgtctctggaggtctgcaagcactggtagtgatattgcagcagacaaggtctgggttgggcgtctgcaggaggagaccttgtgggacatctgaggacatccgcagattcttgtcagcctgtgaactaggccctgcctctgtcacctcattggtccatgaaggagcagccaggggtggtggaaggagcactgggctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaa

SEQ ID NO: 311707 - DNA, 4716 bp, Homo sapiens
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcaggcagttcctgtggagcttccggctgccgggcgaggcccagaagatagaccggatgatggaggcctttgccactcgatactgcctctgcaacccaggcgtcttccagtccacaggtgatccgcccgcctcgacctcccacagtgctgagattacaggcgtgagccaccatgccaagccaaagttactcaatccatacatcaaccgtttgagacacctgctacgtgttgtccttctccatcatcatgctcaacaccagcctccacaatcccaacgtccgggacaggccgcctttcgagcgctttgtgtccatgaaccgcggcatcaacaatggtagcgacctgcccgaggaccagctgcgggttacatgggagtgctcccagaggagaagccgggaaaggacatttcaaaaagaagaagtggccagaacggaggcgtgtcctgattgggaaaggagaggtgtccagtgtggccgagaacctcttcgacagcatcaagagtgagccattctccatccctgaggacgacggcaatgacctcactcacaccttcttcaatccagaccgggagggttggctgctcaagctaggtgagagaccgacagacacacgtcgtcgcacacacactcatgcacgcgcgggcacacatcgttgcatgcacactcctggacgcacaggcccccagctgacacgaggctcacatgcatcctgggggatggagttggacagccccaggtctcctggcccccagtgcagccgtctgcctgccccatccatccacctgtcccgagaaggaagggagccagtggtgggggctgagctgtaagccgggcgagaggcagacagacccactgacaaatgcttcagctgcggttctgtttctctctccccagcggaatggggagggaagtcatagcaggaagtaccatttgttcagaacctactgagctcaggcaaggtgctggtccaccctacagccgaacagtaaagtcagggatctgcctgaggccacacagccagccaggggcagatttgagggcacagagggttaggtgtccctaaaggaggggaggaaggatgacaggatgtggcttagggggaggctcccttcaagctgactgggggcagggagggcctgcaccctgcagagagcagctggggtgggagctgcagtaatagtggctgtagagtccagcagggcaaccccagtgcccggccgtctgcccctgcctcccacacacacttccggaagcctctccagcagggacagccaagccggggacagcgcctccagggcaggtgaggacagatgcctcatgttgaagcaggggtctcaacctggctcacctccagcaacattgagcctccagcacctcctgtctaccaagccccgtgccagtcctgcccagaacccccaggagcccatgagccctctgactctccacaccacaccccagtccatcctcctccagagcactcggccgcctgtcctgccccagccacgtgctgtccgcccccgagaagctctatgtcataaatcttaactcagatgggagagggagcctcagagtcacatagccctgggcccaaaccccagctcctccacccaagtactgatggtcaggttcttcagcctcagtttctgtagctgtaagatggggagaatgatctctgggagggttaaatgtgcggcaaaatggccaagagttgggctctgggactaggacattggggttcgaatcccagctctgctgctgaaccgtgggcaggcgattttacctctccatgactgtttcctcatctgtaaaatggggttaacaatggtctcctcttcatacgtggttgtgaggattaataagtaatattttttgaaacctctagagcagtgtctggcaaatgaaggacgaaatgcttagcattgtgccaggcagggaccaagctaaggaatgaagcaatggatggcggtagccaggaagagcaggaactggccattcctaggaccattcctaggacctgatcacggaggccacccaaacgccagttctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtgtccccttctacgacctggtctctactcggaagaagaagattgccagcaagcagtgagattcctggaggtggcactgggggctggtcaccctgagagtcccatcgcctgcagcacctggagacccacctcccaccccagtgcactcttttgggccacagacatcattgctgttccccgttacctcgagctgactctagaggggaaggcagagctcaggagggtgggtgggagctgcagtgggctcagagtccagcaatgaggccccctggcctgggcacccagctgcaggcccctgccctacgtgcactacaggaaggggtgaggagagcagccagaggaaaaccagccccagaatgctgcaacttctcttctctctggacttcggtgtcctcggctctgaaggcgctctctgcacttagatgctgtcagccctcaacgtaggaggggccgtggggtccctaagtgattcttctccctggcaaggctcttccttttcagggatatctctgccaacccctcccctgtcctcgggttgggcttggccctctctgcctgagagagctcagcacacacacagctcagacccacggacaggaccccgggacagaaccccgggagcactgccctaggagcccggaccccacgagctcagtcccagctctgcctctgactcgctgtgtaccctctgccaagtcatgcccattctctagttcttgcaaaactgcagtgtttggactagaaacgtattggcccctgctagccctgtgctccagcttccagctggagatggcagccgttatttgcggagcccaggctgactccggattcaacgttgctggggagagaaaagcagtatagactccaccttccaggatgtccatttcggggagaggagcaggtgggaccctcaagaaaatgacggagaacatcccagacagatgggactcaagcaggatgggtgctatatccaagaagccaagaagggagagtttcgtgcactgtggttaacaggagggccgcctggaggcagtggctgagccagaaagtaacacagagctcatgcttggagagatagagtcttggccatggctttcctgcaagaccactgacgagcagtcccatggtgataaagggcagcccggcgggtcccagcatctcgagaccctctgcagaagtattatcagagtagagctgacttccagtacccgggcagccagctctgtctccagggaggcctggcctggaggaggagtccactaacaggaaacacttctcaccccctcacacaggcccaggggagcccctggagggaaattccttggcaggggaacaggaaatgtggtcgcctctgccccactgccagcctgagtgggcaaggaagcaggtggatcccccagaaggaaccgcagctcgcgaggcacctctcctcgtccccacccacccccacatttgcacaccttccacagggtcaggatggagtagctgccttgcgaggtggtgagactcctgtctctggaggtctgcaagcactggtagtgatattgcagcagacaaggtctgggttgggcgtctgcaggaggagaccttgtgggacatctgaggacatccgcagattcttgtcagcctgtgaactaggccctgcctctgtcacctcattggtccatgaaggagcagccaggggtggtggaaggagcactgggctaggggtcaggggtcagagattctgtcctgctcctgggatgcactggctactcccttagtctactcccttcccctctctggtcctcagcttcctccatcatggaggagatgggatcatggattttctgggcataagtggctgttctgggagtcattccaaagagagaataaaactcctgatccaa

SEQ ID NO: 311708 - DNA, 1345 bp, Homo sapiens
tgtcaaaagcctgcacacgagacccccgtgggccaggactgacttcctccccacacagggctgggcggggcaagcaggaaggagcctgttacagtcaaggtgacgcatccttgccgggccagcccgaacagcagctgggtcggcaagcgacaggagcacgggtcatcttttccccagaggcgtcggaatggacctgtgccacccagagcccgcggagctgagcagcggggagacggaagagttacagaggatcaagtggcaccgaaagcagctcctggaggacatccagaagctgaaggatgagattgcagatgtgtttgcccaaatcgactgcttcgagagtgcggaggagagccggatggcccagaaggagaaggagctgtgtattgggcgcaagaagttcaacatggaccccgccaagggtatccagtatttcattgagcacaagctgctgacccctgacgtccaggacattgcacggttcctgtataaaggcgagggcctcaacaagacagccattggtacctacctgggggagagggatcccatcaacctgcaggtcctccaggccttcgtggactgccacgagttcgccaacctcaacctcgtccaggccctcaggcagttcctgtggagcttccggctgccgggcgaggcccagaagatagaccggatgatggaggcctttgccactcgatactgcctctgcaacccaggcgtcttccagtccacagacacctgctacgtgttgtccttctccatcatcatgctcaacaccagcctccacaatcccaacgtccgggacaggccgcctttcgagcgctttgtgtccatgaaccgcggcatcaacaatggtagcgacctgcccgaggaccagctgcggaacctcttcgacagcatcaagagtgagccattctccatccctgaggacgacggcaatgacctcactcacaccttcttcaatccagaccgggagggttggctgctcaagctagggggccgcgtgaagacgtggaaacggcgctggttcatcctgaccgacaactgcctctactacttcgagttcaccactgacaaggagccacggggaattatacctcttgagaacctctcggtgcagaaggtggatgaccccaagaagccattctgcctggagctctacaaccctagctgccgaggccagaaaatcaaggcctgcaagaccgatggcgacggcagggtggtggagggcaagcacgaatcgtaccgcatctcagccaccagtgccgaggaacgtgaccagtggatcgagtccatccgagccagcatcacccgtggtcccacctctccccgtggtcccacctct

SEQ ID NO: 311709 - DNA, 420 bp, Homo sapiens
caccagcctccacaatcccaacgtccgggacaggccgcctttcgagcgctttgtgtccatgaaccgcggcatcaacaatggtagcgacctgcccgaggaccagctgcgggtgagagaggcgcagcccacccagcctggccccggggaatccaggagggacctgtccttagatggatggcccgggaggggctcctctgagatagacagcccccagtggggactctgctgatatggcccacccaggctgtgactgtcttgagaggcaccgtcacaaagcgcattggtcctgaaacccgcctgcccaaaagaggcccccatcttgagaaggatgtccgagatagaccacccaggaggtccacccagatttaagcctttgggggactctaggcagccatctttcacatcttccaaaaagggtac

SEQ ID NO: 311710 - DNA, 671 bp, Homo sapiens
tctggcgagcttggcgttccctgtgcgccggaagtgatcccctgcgtggctgggctgctcgggttagatcgtcagaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311711 - DNA, 765 bp, Homo sapiens
tctggcgagcttggcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311712 - DNA, 833 bp, Homo sapiens
gttgcctcgccggccccggttccccaggaccgcctccctcgtttctgcggcgaacattaccgaccttcctgctttaggccacagaacagttgccaaacgctgtccgtcgatcccgaatctcacccaccctcggctctcgttaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311713 - DNA, 643 bp, Homo sapiens
gcctactactactaaattcgcggccgcgtcgacgttagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311714 - DNA, 668 bp, Homo sapiens
tattttgtttttttccgtcaggaaaagcctaaagattagactgtaagaaaagaaaatagaagccatgtttcgaagacctgtattacagctaatgaaagctggattttgaaaatacttggcagcaactcttcggtacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311715 - DNA, 604 bp, Homo sapiens
tggatcccccggggttgcagaaattcgggcccaaggaaaaataaaacgccatgtttaaaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311716 - DNA, 724 bp, Homo sapiens
  misc_feature (683)..(683): n is a, c, g, or t
tctggcgagcttggcgttccctgtgcgccggaagtgatcccctgcgtggctgggctgctcgggttagatcgtcagaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaacaccacaacacnaccaacaaaaaacctgtgcccgctcgcccccaaaacccacc

SEQ ID NO: 311717 - DNA, 721 bp, Homo sapiens
tctggcgagcttggcgttccctgtgcgccggaagtgatcccctgcgtggctgggctgctcgggttagatcgtcagaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcgacaaaactcaggctggagtgatggttttgcccaggatcatgaacttgtaaataatgcagatgggagcagacccaaattttttgactccgagtcttgtgcctctttcccagcaaatcctaagtatctcattg

SEQ ID NO: 311718 - DNA, 2640 bp, Homo sapiens
tctggcgagcttggcgttccctgtgcgccggaagtgatcccctgcgtggctgggctgctcgggttagatcgtcagaaaagcctaaagattagactgtaagaaaagaaaatagaagccatgtttcgaagacctgtattacaggtagtcacttgtctgtattaatactgagatgtattactatcagccacagtgatcagaagacttctttaggcttttaactacaggggcaaaagacctttgagctcacccacccacctctatactcatttgatatggaggattggggacgattttgccagtgtaaattatgttcactaaaacaaaaaaaaagttcaggtttattcacacgtaataggaatcattaatttttaaaatgtgtgtgtgttgcttgaatttaaccagtgagaggacattaaaggtctttagtgacctaaagactgtaggaatcattgttccaacttttttcttaaggcatgtagttgcttttttgaccatctacctcctgtgttgctaaacgttcctcttcccccatctttccacactgaagagagcatctcaagtctcagtggtcaccagagatttcactatgtagaaaatgccttctcattccacttagtatgggtcctcacttttccagacactagcccaccttgagccagcttagactaccatttttcctcacttaccacattcgggcaccagctcctgtagattcttctttggctctcctactccccatcctcctgtgaagaccaatgaagaaccagttcctccatgactctgtcattttccccaccttaatcctatattcttggatccccactttaacctgtatgtatctttaatctatttttttctgtattgaaatgtgaaacatgaaaaagttattgcttcttaacactaacgttacagtattaaaatgtctttaaataagagttaaaagtttaatttaaaaaattatccaagttaaataatcctttcctaatcttctccagtagatttttgtgtgccccaaatgagacattgttattataaatctctgtgtaagatttatgaggtctagcttgtctgagcactcaaatgacatttccagaatcatgacacaggttctcattagcagtttgattctatagtatgttgtactcatatctttattttcttatctgccctctgctcctaagtttagtgataggattagatagccaacagcaccctggggattggtgtttatttgattggtggacttctgctttttatattaacagtactgccacttcaaaaatgtttctctgatagaatggctagctctctgagctctgaattcagtgatgtgtactcccatctttacaggagctcttgaaattaaggaggcagcagagggcttcgggaaagcagtagcattggtgtcaagggccctgggtccttgagatcacttgccacatacttcctgcaggagcttgggcaggtgatgcagtctctctgaggtgttttctcagccctaaatgggaataattttacataacttgtagatttagttttagaattgataatagataaatcccttagctgatattcagtaatgattgctgctattatgtggtagtgactacctttgctgacagtgatgtgactttgacttggacagtcgagtctttgtgtttaatcaaagaaccaaatttattagaccttttttgatgcactaaaaacaggaaatttcctatgaaatatttataaaaactgtattaggctaagctcactactgaagctgtttaatttttgcaatagccttgtgaagtaggtattatgtatcataatttttgcttattttaaaatgaaacactttagattagtcatattaggtatcctaattccttttaaggtctgaaggagcaaccaggggaaggcagtttcatagacacagggaatctgactttggaatatgttcctgttgctgtgtcagaaagtcattcatgtgattagttttagaatgtattgttttgttggaatgtaacctatctctcgttctctaaaccagcagaccccaacctttttggcactgataactggtttcatggaagacaatttttccatggaggaggggggtgccgtggggatggtttcaagatgaaactgttccacctcagatcatcaggcattagttagattctcataaggagtgcacaccctagatccctcgcatgagcggtttataatggggttctgctcctgtgagaatctaatgccactgctgatctgacaggaggcggatcttggtcagtaatgcttgctcgctgcttgctgctcacctcctgctgtgcagccaggttcctaacaggccacagaactctactagtcctcagccctggaggttggggactctcctctaactggctgttcgttatgcctgagagtaaggctttgcatttattccacacctcctgacacttgtttgatcattgcatatgttattaatgaatctacttattaaattattaattataaagcatctcttttaactctcctttggtctaatgatggattaaatcagtacccatgttggatctaaatttcttaatttctaaagtctactgtaaccaaaatacagtagtaatataccagttgtttatactaaaaaaaaaa

SEQ ID NO: 311719 - DNA, 855 bp, Homo sapiens
tctggcgagcttggcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggtggtggcgccatcttcggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311720 - DNA, 654 bp, Homo sapiens
gaattcggcacgaggtgatcccctgcgtggctgggctgctcacccccagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311721 - DNA, 957 bp, Homo sapiens
tctggcgagcttggcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaaaaaaaaaggggggctagaaattctcgggggcagttgcggtccggtttggtaaggcccaagggggttatgagagcgggttaagctggtggaacgtgtggattggagcactggggggatggagccgaaagcggaaaaggtggaacgtggggggtggtaatcgaagtaggaaggagcggttatggaagagtaccc

SEQ ID NO: 311722 - DNA, 1029 bp, Homo sapiens
tctggcgagcttggcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatcaatctacaatataatcatcatttaataatctatatatcttatccattccactaattctcttctattctcctcatctctccatatttctccttttccactctttctcccctcttccttcctcttctctctccctttcttctcttttccc

SEQ ID NO: 311723 - DNA, 996 bp, Homo sapiens
  misc_feature (833)..(833): n is a, c, g, or t
  misc_feature (857)..(857): n is a, c, g, or t
  misc_feature (863)..(863): n is a, c, g, or t
  misc_feature (878)..(878): n is a, c, g, or t
tctggcgagcttggcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaaaaanaaaaantaaaataactattcntcttacactaattttctcctcctccaccacctctctatctcctctttctcttcatttctttactctctctcttctatttccatctatacctcatcccactatctattcttactattcc

SEQ ID NO: 311724 - DNA, 802 bp, Homo sapiens
  misc_feature (731)..(731): n is a, c, g, or t
  misc_feature (733)..(733): n is a, c, g, or t
tctggcgagcttggcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcatancnctccagacagatatactctcttgtgttgctgtgtttggtcgtctggtgtgtgtgtgtgtctgagtttgt

SEQ ID NO: 311725 - DNA, 1970 bp, Homo sapiens
  misc_feature (1842)..(1842): n is a, c, g, or t
  misc_feature (1866)..(1866): n is a, c, g, or t
  misc_feature (1872)..(1872): n is a, c, g, or t
  misc_feature (1887)..(1887): n is a, c, g, or t
tctggcgagcttggcgttccctgtgcgccggaagtgatcccctgcgtggctgggctgctcgggttagatcgtcagaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctggtaagaagcttgtgaaaatagctgtttttttctttttctccttttcttttttaaaagcttggctacactgtaactaactagggttaagagtaccagtacttatgagttaaggcaactcactagaagatgtccataactcttatttctctacttgctaagagtttgtacatttatcccttcctttaaaaaattatttttatacttacagttttagtcacaagtaacttttgaataaagcctaaaactgaattatccatcccagtacttattgttgagaattacaaaaactctgaatgtattgtcttttggaaggatctagccctaaccaggaagaagcgtatgccaagataagaattacactaattgtgagtgtgcagatttattcggaacctctttggtacttagtatgtgaaatttctattgtgaaacttaagatttttttaatttctattttttcgagcctgggtgacagagactccatctccaaaggaaaaacaaaaagttattctgtattgtaatttaaaaataaaatttcttctatttgaatttttaaagttaaaaacgtaagtaaatcctgtcattgctaacagggccacatatggactcttactctttcctctagacccccagagtgtagaatgtgatacacttttgtccttttctctgaggatgtgctgcctagtgtcgtggaatctgcctgaccattgcaagcatccaattttgtgaccagttcttttgcaggaaattgtttctgagaagactggaagacaagaaatatcccacctcttctaacaagatctgaattgttcgaaaagcagccagtgcctaacttgtagctccacttatgccaactgtatatatacctctcgtgagcatagcaagtgatttaatattttgaaaagatggctaaaatccttttaatgaacagcactaaagttatatgtattagaggagaattattgaatgagatggagaaagagttctgaaattaatatttacattttggcttttttacagataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaanaaaaaaaaaaaaaaaaaaaaaaanaaaaantaaaataactattcntcttttatctcttaccccccttcccattcttcttctcctctcttttatccctctattctccactcctcccctccctcctctcc

SEQ ID NO: 311726 - DNA, 1671 bp, Homo sapiens
gaattcggcacgaggtgatcccctgcgtggctgggctgctcacccccagatcgtcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctggtaagaagcttgtgaaaatagctgtttttttctttttctccttttcttttttaaaagcttggctacactgtaactaactagggttaagagtaccagtacttatgagttaaggcaactcactagaagatgtccataactcttatttctctacttgctaagagtttgtacatttatcccttcctttaaaaaattatttttatacttacagttttagtcacaagtaacttttgaataaagcctaaaactgaattatccatcccagtacttattgttgagaattacaaaaactctgaatgtattgtcttttggaaggatctagccctaaccaggaagaagcgtatgccaagataagaattacactaattgtgagtgtgcagatttattcggaacctctttggtacttagtatgtgaaatttctattgtgaaacttaagatttttttaatttctattttttcgagcctgggtgacagagactccatctccaaaggaaaaacaaaaagttattctgtattgtaatttaaaaataaaatttcttctatttgaatttttaaagttaaaaacgtaagtaaatcctgtcattgctaacagggccacatatggactcttactctttcctctagacccccagagtgtagaatgtgatacacttttgtccttttctctgaggatgtgctgcctagtgtcgtggaatctgcctgaccattgcaagcatccaattttgtgaccagttcttttgcaggaaattgtttctgagaagactggaagacaagaaatatcccacctcttctaacaagatctgaattgttcgaaaagcagccagtgcctaacttgtagctccacttatgccaactgtatatatacctctcgtgagcatagcaagtgatttaatattttgaaaagatggctaaaatccttttaatgaacagcactaaagttatatgtattagaggagaattattgaatgagatggagaaagagttctgaaattaatatttacattttggcttttttacagataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311727 - DNA, 1783 bp, Homo sapiens
gttgcctcgccggccccggttccccaggaccgcctccctcgtttctgcggcgaacattaccgaccttcctgctttaggccacagaacagttgccaaacgctgtccgtcgatcccgaatctcacccaccctcggctctcgttaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaaatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctggtaagaagcttgtgaaaatagctgtttttttctttttctccttttcttttttaaaagcttggctacactgtaactaactagggttaagagtaccagtacttatgagttaaggcaactcactagaagatgtccataactcttatttctctacttgctaagagtttgtacatttatcccttcctttaaaaaattatttttatacttacagttttagtcacaagtaacttttgaataaagcctaaaactgaattatccatcccagtacttattgttgagaattacaaaaactctgaatgtattgtcttttggaaggatctagccctaaccaggaagaagcgtatgccaagataagaattacactaattgtgagtgtgcagatttattcggaacctctttggtacttagtatgtgaaatttctattgtgaaacttaagatttttttaatttctattttttcgagcctgggtgacagagactccatctccaaaggaaaaacaaaaagttattctgtattgtaatttaaaaataaaatttcttctatttgaatttttaaagttaaaaacgtaagtaaatcctgtcattgctaacagggccacatatggactcttactctttcctctagacccccagagtgtagaatgtgatacacttttgtccttttctctgaggatgtgctgcctagtgtcgtggaatctgcctgaccattgcaagcatccaattttgtgaccagttcttttgcaggaaattgtttctgagaagactggaagacaagaaatatcccacctcttctaacaagatctgaattgttcgaaaagcagccagtgcctaacttgtagctccacttatgccaactgtatatatacctctcgtgagcatagcaagtgatttaatattttgaaaagatggctaaaatccttttaatgaacagcactaaagttatatgtattagaggagaattattgaatgagatggagaaagagttctgaaattaatatttacattttggcttttttacagataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311728 - DNA, 884 bp, Homo sapiens
gttgcctcgccggccccggttccccaggaccgcctccctcgtttctgcggcgaacattaccgaccttcctgctttaggccacagaacagttgccaaacgctgtccgtcgatcccgaatctcacccaccctcggctctcgttaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggtggtggcgccatcttcggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311729 - DNA, 517 bp, Homo sapiens
  misc_feature (354)..(354): n is a, c, g, or t
  misc_feature (378)..(378): n is a, c, g, or t
  misc_feature (384)..(384): n is a, c, g, or t
  misc_feature (399)..(399): n is a, c, g, or t
gcctactactactaaattcgcggccgcgtcgacgttagatcgtcagcactaaagttatatgtattagaggagaattattgaatgagatggagaaagagttctgaaattaatatttacattttggcttttttacagataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaaaaaaaaaaaaaaaaaaaaaaaaaaaaaaaaaaaaaaaaaaaaaaaaaaaaaaaaaaaaaaaaaaaaanaaaaaaaaaaaaaaaaaaaaaaanaaaaantaaaataactattcntcttacactaattttctcctcctccaccacctctctatctcctctttctcttcatttctttactctctctcttctatttccatctatacctcatcccactatctattcttactattcc

SEQ ID NO: 311730 - DNA, 989 bp, Homo sapiens
acctctccctatggtgtggctggctagcccgggggtctctacgctgcttggtctttgttaacggagatgaaggcagtaatttttcagtaacaggtttcagatataagtcccttggtgatgctaatatttatggaggccttactatgcattaagaacttttttagaagtttagaaaatggcagtgaataaagcagatacaaatctctgctctaagggagcttgcatagtaatgaaatttgagaagacagtggattggaagtgggattaactcagaatcaaaattttgtcgatgggttggaggaagaggaagttatttgggaccaaaaagacatacaggtgtgagtttatttgggagggaggaaggaatcctcatcagatgtgcaggaatgttggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311731 - DNA, 899 bp, Homo sapiens
  misc_feature (800)..(800): n is a, c, g, or t
tctggcgagcttggcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaaaaaaaaaaaaaaaaaaaaaaaaaatgtgggggcgnccgaaatttaaaatttggggggggcagaaaaggtgagcaaaaacgggagggggttccaaaaaggggggggtgaaaggttgttggttaggaaccgcgggg

SEQ ID NO: 311732 - DNA, 827 bp, Homo sapiens
  misc_feature (740)..(740): n is a, c, g, or t
tctggcgagcttggcgttccctgtgcgccggaagtgatcccctgcgtggctgggctgctcgggttagatcgtcagaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaaaaaaaaaacaacaaaaaaacactttttggggcgctgggccccgaaaaatttttaaaccttcgttgggcncggggccccattgggtttagggacacgtggggcaaggggtcccaaggaaacccggggccggacctggggtgggtttccccattagag

SEQ ID NO: 311733 - DNA, 465 bp, Homo sapiens
tctggcgagcttggcgttccctgtgcgccggaagtgatcccctgcgtggctgggctgctcgggttagatcgtcagaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttcgtgggcagcgctgcccacgaagtggctgcccacaagtggaaaaaaagcagtagacaaggaacagcaaataaatttatcttgcatgccactttcagtcaacaggatgtggctctctagatagctgtgtttagaaggaatctgaggcttcagcctcacacaggggaaagactactgcgattgatagcaatatccaacatctcactcaacccagaagaaaccaatggcacttcgtgggcagcgggt

SEQ ID NO: 311734 - DNA, 905 bp, Homo sapiens
gttgcctcgccggccccggttccccaggaccgcctccctcgtttctgcggcgaacattaccgaccttcctgctttaggccacagaacagttgccaaacgctgtccgtcgatcccgaatctcacccaccctcggctctcgttaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311735 - DNA, 1047 bp, Homo sapiens
  misc_feature (919)..(919): n is a, c, g, or t
  misc_feature (943)..(943): n is a, c, g, or t
  misc_feature (949)..(949): n is a, c, g, or t
  misc_feature (964)..(964): n is a, c, g, or t
tctggcgagcttggcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaataaaaaaaaaaaaaaaaanaaaaaaaaaaaaaaaaaaaaaaanaaaaantaaaataactattcntcttttatctcttaccccccttcccattcttcttctcctctcttttatccctctattctccactcctcccctccctcctctcc

SEQ ID NO: 311736 - DNA, 1006 bp, Homo sapiens
tctggcgagcttggcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaaaaaaaaaaaaaaaaaaaaaaaaaaaaaaaaaaaaaaaaaaaaaaaaaaaaaaaaaaaaaaaaaaaatataaataaatatccttcttatacttctcttttctactttattatctactcctcttttcttatttttactctaaccctacaacttcttcttcattctcttccacttatcttccatcttctcttctcttctaccttatatcactatttctcctccacattttctctccaccttccc

SEQ ID NO: 311737 - DNA, 1688 bp, Homo sapiens
tctggcgagcttggcgttccctgtgcgccggaagtgatcccctgcgtggctgggctgctcgggttagatcgtcagaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctggtaagaagcttgtgaaaatagctgtttttttctttttctccttttcttttttaaaagcttggctacactgtaactaactagggttaagagtaccagtacttatgagttaaggcaactcactagaagatgtccataactcttatttctctacttgctaagagtttgtacatttatcccttcctttaaaaaattatttttatacttacagttttagtcacaagtaacttttgaataaagcctaaaactgaattatccatcccagtacttattgttgagaattacaaaaactctgaatgtattgtcttttggaaggatctagccctaaccaggaagaagcgtatgccaagataagaattacactaattgtgagtgtgcagatttattcggaacctctttggtacttagtatgtgaaatttctattgtgaaacttaagatttttttaatttctattttttcgagcctgggtgacagagactccatctccaaaggaaaaacaaaaagttattctgtattgtaatttaaaaataaaatttcttctatttgaatttttaaagttaaaaacgtaagtaaatcctgtcattgctaacagggccacatatggactcttactctttcctctagacccccagagtgtagaatgtgatacacttttgtccttttctctgaggatgtgctgcctagtgtcgtggaatctgcctgaccattgcaagcatccaattttgtgaccagttcttttgcaggaaattgtttctgagaagactggaagacaagaaatatcccacctcttctaacaagatctgaattgttcgaaaagcagccagtgcctaacttgtagctccacttatgccaactgtatatatacctctcgtgagcatagcaagtgatttaatattttgaaaagatggctaaaatccttttaatgaacagcactaaagttatatgtattagaggagaattattgaatgagatggagaaagagttctgaaattaatatttacattttggcttttttacagataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311738 - DNA, 871 bp, Homo sapiens
tctggcgagcttggcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcggattctgacacagccagcagcagtacgtgttcatcagcactgaagcagggcacctcctgattcagcagagagaccctcccctccccagccatgttggcggctgccctaggattgctgatgcccattgcaggggctgaatttctcattggcctggttggaaatggagtccctgtggtctgcagtttta

SEQ ID NO: 311739 - DNA, 689 bp, Homo sapiens
  misc_feature (523)..(523): n is a, c, g, or t
  misc_feature (543)..(543): n is a, c, g, or t
  misc_feature (581)..(581): n is a, c, g, or t
  misc_feature (616)..(616): n is a, c, g, or t
  misc_feature (674)..(675): n is a, c, g, or t
tctggcgagcttggcgttccctgtgcgccggaagtgatcccctgcgtggctgggctgctcgggttagatcgtcagaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgatgtcagtcaaaagacaacatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgatnaatattattatttcttgagntggaccccagacgacaaagaagaaaggggagttagaanagggaaatgattctttctttttggcccaatcaatnttgggttgacacgttcctctcatttctctccaaagttccgttgtcaatataattcctnnttatcccgcctctc

SEQ ID NO: 311740 - DNA, 766 bp, Homo sapiens
gttgcctcgccggccccggttccccaggaccgcctccctcgtttctgcggcgaacattaccgaccttcctgctttaggccacagaacagttgccaaacgctgtccgtcgatcccgaatctcacccaccctcggctctcgttaggtgagggaggaagggatagccagcgcgaaggaagtgctggagtcgtgtgttttggctgcgcgtgatcctgcgtgggtcgggaggtgtttctgtgaaaagcctaaagattagactgtaagaaaagaaaatagaagccatgtttcgaagacctgtattacaggtacttcgtcagtttgtaagacatgagtccgaaacaactaccagtttggttcttgaaagatccctgaatcgtgtgcacttacttgggcgagtgggtcaggaccctgtcttgagacaggtggaaggaaaaaatccagtcacaatattttctctagcaaatggcacagaatatcagtattccggccaggcctcagagacgtggcatatcaatatgtgaaaaaggggtctcgaatttatttggaagggaaaatagactatggtgaatacatggataaaaataatgtgaggcgacaagcaacaacaatcatagctgataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaa

SEQ ID NO: 311741 - DNA, 329 bp, Homo sapiens
gtaggcagggctggactgtaagtctaggcagacagtatctgaagtccgagatgcccaagggttagcccaaatagcagaattgatctttgcccctaagagagtctttttggtctctactcagtgttatattttgttctgggtgacagccctgagcccacaggaatagaacaaaaagagagaggaagaaaagaggctgaccagtgaatgttatttatgagggctggtaagcaacattgcttaacttaatgtcagatgtttttgacattgctctaagttgtgcatgaaagaaattacaaggcctcagaattatttgcccaagtgtattcttt

SEQ ID NO: 311742 - DNA, 16379 bp, Homo sapiens
cgcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcgctgcaggagatgctggctaacaccgtggagaaatcagaagggcaagttgatgtggaaaaatggaaattcatgatgaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcgcaagaagcaatggtggacaagttggcagaaaatgcacataatgtgtgggcgcgggatcgaatccggcagggctggacttatggcatccaacaggacgtaaagaacagaagaaatcctcgccttgttccctacactcctctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttctcagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgtcccattattaaatgaacacgcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggctaggactatgagaactgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacaagaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcgtcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacattccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagatactgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcgaagacattactgtctggtggaacatcctcagagatctaaaaaggctgtatggcataaactactgtctaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcgaagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaaacgggtggtgtgtctcaggacaaaaggaggctcttctcattcagctaaattcacatttgcccccccccgcctgcccccgcccccatatgctcctgctattattttggtaatgctctgatgcaacattgcaactttatgaaatatttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgcctcattctttcagccacctgtgatcagttttgttgattaaggacttcttgtcaggccattttttaatatcaaagctgaagcaatatccattcagggatttcatcagttgcgtcacaaaacacggatgataatatacatcactccattttttccattttgagtccttttaaatgtaatgctaacctttacaattaaaaagtcagattcagaatggaaacaaggtcattttgcaaacattggagctcttttattacaagtctgcttgttaattttagaactgtaaaaccgctctgattaaactatttaactaacaaaaaaaaac

SEQ ID NO: 311743 - DNA, 2101 bp, Homo sapiens
aactgtagatgggatgtctcatagcttggtatttgatttggccttttctaaaggaaagtaatctgtacctattcccccttggtcgtccgactttgtttgggtgggtactaagtttgtagtttcagttgaagacacagttaatcctgcttagataactttagtcaatgtcatgaacaagagttgatcactaagcctggacattttcacctaggctagagaaaggaagagacgttgcttttcagccatcatcatcatcatcttgttccctgtctgcgtctgctacttcttgctgctggtacctgtgtcatttaagccaacaccaagatatagttacagcgacagttccatttatattcgtgggcttggcacagcctccatgtgatgatctttgacgtgtattgagtgaaccaaataatagctgcccctacatggcgagttgtgttttccttttgttttgctttctgaactctgacgttaatatttccctttgttttctagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcgaagctctgtttcggaagagctgtttcctccccccaccttttgtatttactttgagactaaagactgaagaataatctaaattcatactcagacaaaaaaaggaattctggaaagaaaaccattctggacactgtcataacacacatagatagattttcttctgagactcccggagtcttctcgagctacgagaccttcacagagacacgtggcagccacactcacccagcctctttatttcaccatcctggaaggaaactgtctgtctaatggtcacagagcactgtagcacttaacagattgccatggacaccagttgcgaagggaaatagtgccttactatatgtgggttgagctatgcagaagatacgtgcatgaaaaaacatctttattttctttatgtcgacctttcttttcttagattgattttgtgaggttttttttttttcctttagtcttttctttagtgggggagggtaagaaaagcagtttgcacttaaaaagaaaaaaaaaaaaacgggtggtgtgtctcaggacaaaaggaggctcttctcattcagctaaattcacatttgcccccccccgcctgcccccgcccccatatgctcctgctattattttggtaatgctctgatgcaacattgcaactttatgaaatatttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgcctcattctttcagccacctgtgatcagttttgttgattaaggacttcttgtcaggccattttttaatatcaaagctgaagcaatatccattcagggatttcatcagttgcgtcacaaaacacggatgataatatacatcactccattttttccattttgagtccttttaaatgtaatgctaacctttacaattaaaaagtcagattcagaatggaaacaaggtcattttgcaaacattggagctcttttattacaagtctgcttgttaattttagaactgtaaaaccgctctgattaaactatttaactaacaaaaaaaaac

SEQ ID NO: 311744 - DNA, 471 bp, Homo sapiens
caactgagaccttctatgatgcagcacttactcagaagattagtatttgatgtcccattattaaatgaacacgcaaagatgcctcttaaagtaagtataggaaatgtttgtagatatttgattactggcttctctgactttattttctatgacaacatatacatttcttagatacatcatgcttgacgctgggaaatttctcccaattattgaaatgggcatagaagttataggaatgtatacatcaacttgaaataaacaacttctataagattatagaaatcttaacattgatttccatggaaacaatggaaatagaaatcaattgaaaaaaaaggaccacaggccgggcgcggtggctcacgcctgtaatcccagcactttgggaggccaaggtgggcggatcacgaggttaggagatcgagaccatcctagctaacacggtgaaaccccgtctctataaaaaataca

SEQ ID NO: 311745 - DNA, 546 bp, Homo sapiens
ggtgtaggcagggctggactgtaagtctaggcagacagtatctgaagtccgagatgcccaagggttagcccaaatagcagaattgatctttgcccctaagagagtctttttggtctctactcagtgttatattttgttctgggtgacagccctgagcccacaggaatagaacaaaaagagagaggaagaaaagaggctgaccagtgaatgttatttatgagggctggtaagcaacattgcttaacttaatgtcagatgtttttgacattgctctaagttgtgcatgaaagaaattacaaggcctcagaattatttgcccaagtgtattctttaaatatttttttctgcctctctgtttttttatactaggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctgtaagcagtatgagagtgcactggcagaatgac

SEQ ID NO: 311746 - DNA, 15812 bp, Homo sapiens
cgcgcggccccctccagcccccggctcccggcagcagaagcagaaggcagcgccaggggccgccgccgccgccgagctccgcggggctcgggagccggccccggcgaggaggcgcggaaccatggccgatgggggcgagggcgaagacgagatccagttcctgcgaactgatgatgaagtggttctgcagtgcaccgcaaccatccacaaagaacaacagaagctatgcttggcagcagaaggatttggcaacagactttgtttcttggagtccacttccaattccaagaatgtgcccccagacctctccatctgcacctttgtgctggagcagtccctctctgtccgggcgctgcaggagatgctggctaacaccgtggagaaatcagaagggcaagttgatgtggaaaaatggaaattcatgatgaagactgctcaaggtggtggtcatcgaacactcctctacggacatgccatattgctgcgccattcctatagtggcatgtatctgtgctgcctgtccacctcccggtcttcaactgataagctggcttttgatgttggcttgcaagaggacaccacaggggaggcttgttggtggaccatacaccctgcctctaagcagcgatcagaaggagaaaaagtacgagttggagatgacctcatcttagttagcgtgtcctctgaaaggtacttgcacttgtcttatggcaacggcagcttacacgtggatgccgctttccagcagactctctggagcgtggccccaatcagctcaggaagtgaggcagcccaagggtatctcattggtggtgatgtcctcaggttgctgcatggacacatggacgagtgtctcactgtcccttcaggagaacatggtgaagagcagcggagaactgttcattatgaaggtggcgctgtgtctgttcatgcacgttccctttggagactagagacgctaagagttgcgtggagtggaagccacataagatggggacagccattccgactacgccatgtcacaacaggaaaatacttgagtctcatggaagacaaaaaccttctactcatggacaaagagaaagctgatgtaaaatcaacagcatttaccttccggtcttccaaggaaaaattggatgtaggggtgagaaaagaagtagatggcatgggaacatctgaaataaaatacggtgactcagtatgctatatacaacatgtagacacaggcctatggcttacttaccagtctgtggacgtgaaatccgtgagaatgggatctatacaacgtaaggctattatgcatcatgaaggccacatggatgatggcataagtttgtcgagatcccagcatgaagaatcacgcacagcccgagttatccggagcacagtcttccttttcaatagatttataaggggccttgatgctctcagcaagaaagcgaaggcttccacagtcgatttgcctatagagtccgtaagcctaagtctgcaggatctcattggctacttccaccccccagatgagcatttagagcatgaagacaaacagaacagactacgagccctgaagaatcggcaaaatctcttccaggaagagggaatgatcaacctcgtgcttgagtgcatagaccgtttgcacgtctacagcagtgcagcacactttgctgatgttgctgggcgagaagcaggagagtcttggaaatccattctgaattctctgtatgagttgctggcggctctaattagaggaaatcgtaaaaactgtgctcaattttctggctccctcgactggttgatcagcagattggaaagactggaagcttcttcaggcattctggaagttttacactgtgttttagtagaaagtccagaagctctaaatattattaaagaaggacatattaaatctattatctcacttttagacaaacatggaagaaatcacaaggttctggatgtcttgtgctcactctgtgtttgccacggggttgcagtccgttctaaccagcatctcatctgtgacaatctcctaccaggaagagacttgttattgcagacacgtcttgtgaaccatgtcagcagcatgagacccaatatttttctgggcgtcagtgaaggttctgctcagtataagaaatggtactatgaattgatggtggaccacacagagccctttgtgacagctgaagcaactcacctgcgagtgggctgggcttccactgaaggatattctccctaccctggagggggcgaagagtggggtggaaatggtgttggagatgatctcttctcctatggatttgatggccttcatctctggtcaggttgtattgctcgtactgtaagctcaccaaaccaacatctgttaagaactgatgatgtcatcagttgctgtttagatctgagtgccccaagcatctcgttccgaattaatggacaacctgttcaaggaatgtttgagaatttcaacatcgatggcctcttctttccagtcgttagtttctctgcaggaataaaagtacgctttctgcttggagggcgacatggagaattcaaatttcttcctccacctgggtatgctccttgttatgaagctgttctgccaaaagaaaagttgaaagtggaacacagccgagagtacaagcaagaaagaacttacacacgcgacctgctgggccccacagtttccctgacgcaagctgccttcacacccatccctgtggataccagccagatcgtgttgcctcctcatctagaaagaataagagaaaaactggcagagaatatccatgaactctgggttatgaataaaattgagcttggctggcagtatggtccggttagagatgacaacaagagacaacacccatgcctggtggagttctccaagctgcctgaacaggagcgcaattacaacttacaaatgtcgcttgagaccctgaagactttgttggcattaggatgtcatgtgggtatatcagatgaacatgctgaagacaaggtgaaaaaaatgaagctacccaagaattaccagctgacaagtggatacaagcctgcccctatggacctgagctttatcaaactcaccccatcgcaagaagcaatggtggacaagttggcagaaaatgcacataatgtgtgggcgcgggatcgaatccggcagggctggacttatggcatccaacaggacgtaaagaacagaagaaatcctcgccttgttccctacactcctctggatgaccgaaccaagaaatccaacaaggacagcctccgcgaggctgtgcgcacgctgctggggtacggctacaacttggaagcaccagatcaagatcatgcagccagagccgaagtgtgcagcggcaccggggaaaggttccgaatcttccgtgccgagaagacctatgcagtgaaggccggacggtggtattttgaatttgagacggtcactgctggagacatgagggttggttggagtcgtcctggttgtcaaccggatcaggagcttggctcagatgaacgtgcctttgcctttgatggcttcaaggcccagcggtggcatcagggcaatgaacactatgggcgctcttggcaagcaggcgatgtcgtggggtgtatggttgacatgaacgaacacaccatgatgttcacactgaatggtgaaatccttcttgatgattcaggctcagaactggctttcaaggactttgatgttggcgatggattcatacctgtgtgtagccttggagtggctcaagtgggtaggatgaactttggaaaggatgtcagcaccttgaaatatttcaccatctgtggcttacaagagggctatgaaccatttgccgttaatacaaacagggatattaccatgtggctgagcaagaggcttcctcagtttcttcaagttccatcaaaccatgaacatatagaggtgaccagaatagacggcaccatagacagttccccatgtttaaaggtcactcagaagtcttttggttctcagaacagcaacactgatatcatgttttatcgcctgagcatgccgatcgagtgcgcggaggtcttctccaagacggtggctggagggctccctggggctggcctttttgggcccaagaatgacttggaagattatgatgctgattctgactttgaggttctgatgaagacagctcatggccatctagtgcccgatcgtgttgacaaagacaaagaagctactaaaccagagtttaacaaccacaaagattatgcccaggaaaagccctctcgtctgaaacaaagatttttgcttagaagaacaaagccagattacagcacaagccattctgcaagactcaccgaagatgtccttgctgatgatcgggatgactatgatttcttgatgcaaacgtccacgtactattactcagtgagaatctttcctggacaagaacctgctaatgtctgggtgggctggattacatcagatttccatcagtatgacacaggctttgacttggacagagttcgcacagtaacagttactctaggagatgaaaaaggaaaagtgcatgaaagcatcaaacgcagcaactgctatatggtatgtgcgggtgagagcatgagccccgggcaaggacgcaacaataatggactggagattggctgtgtggtggatgctgccagcgggctgctcacattcattgccaatggcaaggaactgagcacatactatcaggtggaaccgagtacaaaattatttcctgcggtttttgcacaagctacaagtcccaatgttttccagtttgagttgggaagaataaagaatgtgatgcctctctcggcgggattattcaagagtgagcacaagaaccccgtgccgcagtgccccccgcgcctccacgtgcagttcctgtcacacgtcctgtggagcagaatgcccaaccagtttttgaaggtagatgtgtctcgaataagtgaacgccaaggctggttggtgcagtgtttggatcctctgcagttcatgtctcttcatatccctgaggaaaacagatctgttgacatcttagagttgacagagcaggaggaattgctgaaatttcactatcacactctccggctctactcagccgtctgtgctcttgggaaccaccgggtggcccatgccctgtgcagccatgtggatgaacctcagctcctctatgccattgagaacaagtacatgcctggtttgctgcgtgctggctactatgacctgctgattgacatccacctgagctcctatgccactgccaggctcatgatgaacaacgagtacattgtccccatgacggaggagacgaagagcatcaccctgttccctgatgagaacaaaaaacacggccttccagggatcggcctcagcacctccctcaggccacggatgcagttttcctcccccagttttgtaagcattagtaatgaatgttaccagtacagtccagagttcccactggacatcctcaagtccaaaaccatacagatgctgacagaagctgttaaagagggcagtcttcatgcccgggacccagttggagggactactgaattcctctttgtacctctcatcaagcttttctataccctgctgatcatgggcatctttcacaacgaggacttgaagcacatcttgcagttgattgagcccagtgtgtttaaagaagctgccactccggaggaggagagtgacacgctggagaaagagctcagtgtggacgatgcaaagctgcaaggagctggtgaggaagaagccaaggggggcaagcggcccaaggaaggcctgctccaaatgaaactgccagagccagttaaattgcagatgtgcctactgcttcagtacctctgtgactgccaggtccggcaccggatagaagccattgtagccttttcagatgattttgtggctaagctccaagacaatcaacgtttccgatacaacgaagtcatgcaagccttaaacatgtcagctgcactcacagccaggaagacaaaggaatttagatcaccacctcaagaacagatcaatatgcttctcaattttaaggatgacaaaagtgaatgtccatgtccagaagaaattcgtgaccaactattggatttccatgaagatttgatgacacattgtggaattgagctggatgaagatgggtctctggatggaaacagtgatttaacaattagagggcgtctgctatccctggtagaaaaggtgacatatctgaagaagaagcaagcagaaaaaccagttgagagtgactccaaaaagtcctccactctgcagcagctgatttctgagaccatggtccgatgggctcaggagtctgtcattgaagaccccgagctggtgagggccatgtttgtgttgctccatcggcagtatgacggcattgggggtcttgttcgggccctgccaaagacctacacgataaatggtgtgtccgtggaggacaccatcaacctgctggcatcccttggtcagattcggtccctgctgagtgtgagaatgggcaaagaagaagagaagctcatgattcgtggattaggggatattatgaataacaaagtgttttaccagcaccctaatctcatgagggcactggggatgcacgagactgtgatggaggtcatggtgaacgtccttggaggtggagagtccaaggaaatcacctttcccaagatggtggccaactgttgccgttttctctgttacttctgtcgtataagtaggcagaatcaaaaagctatgtttgatcatctcagttatttactggaaaacagcagtgttggtcttgcctccccagctatgagaggttcaacaccactggatgtggctgcagcttcggtgatggataataatgaactagcattagctctgcgtgagccggatctagaaaaggtagttcgttatttggctggttgtggactgcaaagttgccagatgctggtgtctaagggctatccagacattgggtggaacccagttgaaggagagagatatcttgactttctcagatttgctgtcttctgtaatggggagagtgtggaggaaaatgcaaatgtcgtggtgagattgctcattcggaggcctgagtgttttggtcctgctttgagaggagaaggtgggaatgggcttcttgcagcaatggaagaagccatcaaaatcgccgaggatccttcccgagatggtccctcaccaaatagcggatccagtaaaacacttgacacagaggaggaggaagatgacactatccacatggggaacgcgatcatgaccttctattcagctttgattgacctcttgggacgctgtgctcctgagatgcatttgattcatgccgggaagggagaagccatcagaattaggtccattttgagatccctcattcccctgggagatttggtgggcgttatcagcatcgcttttcagatgccaacaatagccaaagatgggaatgtggtggaacctgacatgtctgcggggttttgcccagatcacaaggcagccatggttttattccttgacagggtctatgggattgaggttcaagacttcctcctccatcttcttgaggttggctttctgccagatctccgggcggctgcttctttagatacggcagctttgagtgctacagacatggccttggccctcaatcggtacctttgcacagccgtcttgccattgttaacaagatgtgctcctctctttgctggcacagagcaccacgcttctctcattgactcattacttcatactgtgtatagactttctaagggctgttcacttaccaaagctcagcgggattccatagaagtttgtttactctctatttgtggacaactgagaccttctatgatgcagcacttactcagaagattagtatttgatgtcccattattaaatgaacacgcaaagatgcctcttaaactgctgacaaatcattatgaaagatgctggaaatattactgcctgcctggagggtggggaaactttggtgctgcctcagaagaagaacttcatttatcaagaaagttgttctggggcatttttgatgccctgtctcaaaagaaatatgaacaagaacttttcaaactggcactgccttgcctgagtgcagttgcgggagctttgcctccagactacatggagtcaaattatgtcagtatgatggaaaaacagtcatcaatggattctgaagggaactttaacccacaacctgttgatacctcaaatattacaattcctgagaaattggaatacttcattaacaaatatgcagaacactcccatgacaaatggtcaatggacaagttggcaaatggatggatttatggagaaatatattcagactcttctaaggttcagccattaatgaagccatataagctattgtctgaaaaggaaaaagaaatttatcgctggccaatcaaagaatctttaaaaactatgctggctaggactatgagaactgaaagaactcgggagggagacagcatggccctttacaaccggactcgtcgtatttctcagacaagccaggtttctgtggacgctgcccatggttacagtccccgggccattgacatgagcaatgttacactatctagagacctgcatgctatggcagaaatgatggctgaaaactaccataatatatgggcaaagaaaaagaaaatggagttggagtccaaaggaggaggaaaccatcctctgctggtgccctatgatacactgacagccaaagagaaagccaaggatagagaaaaagcacaggacatcctcaagttcttgcagatcaatggatatgctgtatccagaggatttaaggacctggaactggacacgccttctattgagaaacgatttgcctatagtttcctccaacaactcattcgctatgtggatgaagcccatcagtatatcctggagtttgatggtggcagcagaggcaaaggagaacatttcccttatgaacaagaaatcaagttctttgcaaaagtcgttcttcctttaattgatcagtatttcaaaaaccatcgtttatacttcttatctgcagcaagcagacctctctgctctggaggacatgcttccaacaaagagaaagaaatggtgactagcctattctgcaaacttggagttcttgtcaggcataggatttcactatttggcaatgatgcaacatcaattgtcaactgtcttcatattttgggtcagactttggatgcaaggacagtgatgaagactggcctggagagtgttaaaagtgcactcagagcttttctggacaacgctgcagaggatctggagaagaccatggaaaacctcaagcagggccagttcactcacacccgaaaccagcccaaaggggttactcagattatcaattacaccacagtggccctgctgccaatgctgtcgtcattatttgaacatattggccagcatcagttcggagaagacctaatattggaagatgtccaggtgtcttgttatagaattctgactagcttatatgctttgggaaccagcaagagtatttacgtggagaggcaacgttctgcattaggagaatgtctagctgcctttgctggtgcttttcctgtagcatttttggaaactcatctggacaaacataatatttactccatctacaataccaagtcttcacgagaaagagcagctctcagtttgccaactaatgtggaagatgtttgtccaaacattccgtctttggagaaactcatggaagaaatcgtggaattagccgagtccggcattcgctacactcaaatgccacatgtcatggaagtcatactgcccatgctttgcagctacatgtctcgttggtgggagcatggacctgagaacaatccagaacgggccgagatgtgctgcacagccctgaactcagagcacatgaacacacttctagggaacatattgaaaatcatatataataacttggggattgatgagggagcctggatgaagaggctagcagtgttttcccagcctataataaataaagtgaaacctcagctcttgaaaactcatttcttgccgttaatggagaaactcaagaaaaaggcagctacggtggtgtctgaggaagaccacctgaaagctgaggccaggggggacatgtcggaggcagaactcctcatcctagatgagttcaccacactggccagagatctctatgccttctaccctctcttgattagatttgtggactataacagggcaaagtggctaaaggagcctaacccagaagcagaggagctcttccgcatggtggctgaagtgtttatctactggtcgaagtcccataatttcaaaagagaagagcagaacttcgttgtacagaatgaaatcaacaatatgtctttccttattactgataccaagtcaaagatgtcaaaggcagctgtttctgatcaggaaaggaagaaaatgaagcgcaaaggagatcggtattccatgcagacctctctgattgtagcagctctgaagcggttactgcccattgggttgaacatctgtgcccctggggaccaggagctcattgctctggccaaaaatcgatttagcctgaaagatactgaggatgaagtacgagatataatccgcagcaatattcatttacaaggcaagttggaggatcctgctattagatggcaaatggctctttacaaagacttaccaaacaggactgatgatacctcagatccagagaagacggtagaaagagtattggatatagcaaatgtgctttttcatcttgaacagaagtctaaacgtgtgggtcgaagacattactgtctggtggaacatcctcagagatctaaaaaggctgtatggcataaactactgtctaagcagaggaaaagggctgttgtagcctgcttccggatggcccccttatataatctgccaaggcatcgggctgtcaatctctttcttcagggatatgaaaagtcttggattgaaacagaagaacattactttgaagataaactgatagaagatttagcaaaacctggggctgaacctccagaagaagatgaaggcactaagagagttgatcctctacatcagctgatccttctgtttagtcggacagctttaacagagaaatgcaaactggaggaagattttttatatatggcctatgcagatattatggcaaagagttgtcatgatgaggaagatgacgatggtgaagaggaagtgaagagttttgaagaaaaagaaatggaaaagcaaaagcttctataccagcaagcccgactccacgatcgtggcgcggctgagatggtgctacagacaatcagtgccagcaaaggtgaaactggaccaatggtagcagctactctgaaacttggaattgctattttaaatggtgggaactccacagtacagcagaaaatgcttgactacctcaaggagaaaaaggatgtgggcttctttcagagcctggccggcctgatgcagtcatgtagtgtccttgacctaaatgcatttgagcgacaaaacaaagctgaaggtcttgggatggtgacagaggaaggatcaggagaaaaggttctgcaggacgatgagttcacctgtgacctcttccgattcctgcaactactctgtgagggacacaactcagattttcagaattatctgagaactcagactggcaataatacaactgtcaacataattatctccactgtagactacctactgagagttcaggaatcaattagtgacttttattggtattactctgggaaagatgttattgatgaacaaggacaacggaatttctccaaagctatccaagtggcaaaacaagtctttaacactcttacagagtatattcagggtccttgcactgggaatcaacagagtttggcacacagcaggctgtgggatgctgtggtcggctttcttcatgtgtttgcccatatgcagatgaagctgtcgcaggattccagtcaaattgagctattaaaagaattaatggatctgcagaaggatatggtggtcatgttgctgtccatgttagaaggtaatgttgttaatggaacgattggcaaacagatggtggatatgcttgtggaatcttccaacaacgtggagatgattctcaaattttttgacatgttcttaaaactaaaggatttgacgtcgtctgatacttttaaagaatatgaccccgatggcaagggagtcatttccaagagggacttccacaaagcgatggagagccataagcactacacgcagtcagaaacggaatttcttttgtcttgtgcggagacggatgagaatgaaaccctcgactacgaagagttcgtcaaacgcttccacgaacctgcgaaggacatcggcttcaacgtcgccgtccttctgacaaacctctctgagcacatgcccaacgatacccgacttcagacttttctggaattagcagagagcgtcctgaattatttccagccctttctgggccgcatcgaaatcatgggaagcgccaaacgcatcgagagggtctattttgaaatcagtgagtccagccgaacccagtgggagaagccccaggtcaaggagtccaaaagacagttcatatttgacgtggtcaacgaaggcggagagaaagagaagatggaactctttgtgaacttctgcgaggacaccatctttgaaatgcagctggcggctcagatctcggagtcggacttgaacgagaggtcagcgaataaggaagaaagcgagaaggagaggccggaagagcaggggccgaggatggctttcttctccattctgacggtcaggtcggccctgtttgcgctcaggtacaatatcttgacccttatgcgaatgctcagtctgaagagcctgaagaagcagatgaaaaaagtaaaaaagatgaccgtgaaggacatggtcacggccttcttttcatcctactggagtattttcatgaccctcttgcacttcgtggccagcgttttcagaggctttttccgcatcatttgcagcctgctgcttgggggaagcctcgtcgaaggtgctaaaaagatcaaagttgcagaactgttagccaacatgccagaccccactcaggatgaggttagaggagatggggaggagggagagaggaaacccctggaagccgccctgccctccgaggatctgaccgacttaaaggagctgacagaggaaagtgaccttctttcggacatctttggcctggatctgaagagagaaggaggacagtacaaactgattcctcataatccaaatgctgggctcagtgacctcatgagcaacccagtccccatgcctgaggtgcaggaaaaatttcaggaacagaaggcaaaagaagaagaaaaggaagaaaaagaagaaaccaaatctgaacctgaaaaagccgagggagaagatggagaaaaagaagagaaagccaaggaagacaagggcaaacaaaagttgaggcagcttcacacacacagatacggagaaccagaagtgccagagtcagcattctggaagaaaatcatagcatatcaacagaaacttctaaactattttgctcgcaacttttacaacatgagaatgttagccttatttgtcgcatttgctatcaatttcatcttgctcttttataaggtctccacttcttctgtggttgaaggaaaggagctccccacgagaagttcaagtgaaaatgccaaagtgacaagcctggacagcagctcccatagaatcatcgcagttcactatgtactagaggagagcagcggctacatggagcccacgttgcgtatcttagctattctgcacacggtcatttctttcttctgcatcattggatactactgcttgaaagtcccattggttatttttaagcgagaaaaggaagtggcacggaaattggaatttgatgggctttatattacagaacagccttcagaagatgatattaaaggccagtgggatagactcgtaatcaacacacagtcatttcccaacaactactgggacaaatttgttaaaagaaaggttatggataaatatggagagttctacggccgagacagaatcagtgaattacttggcatggacaaggcagctctggacttcagtgatgccagagaaaagaagaagccaaagaaagacagctccttatcagctgtactgaactccattgatgtgaagtatcagatgtggaaactaggagtcgttttcactgacaactccttcctctacctagcctggtatatgactatgtctgttcttggacactataacaactttttttttgccgctcaccttctcgacattgctatgggattcaagacattaagaaccatcttgtcctcagtaactcacaatggcaaacagctcgtattaaccgttggcttattagctgttgttgtatacctatacactgtggtggcattcaattttttccgaaaattctacaataaaagtgaagatggtgatacaccagatatgaaatgtgacgatatgctaacatgctatatgttccacatgtatgttggagttcgtgctggaggagggatcggggatgaaatcgaagacccagcaggagatgaatatgagatctatcgaatcatctttgacatcactttcttcttctttgttattgtcattctcttggccataatacaaggtctaattattgatgcttttggagaactaagagaccaacaggaacaagtcaaagaagacatggagaccaaatgcttcatctgtgggataggcaatgattacttcgacacagtgccacatggctttgaaacccacactttacaggagcacaacttggctaattacttgttttttctgatgtatcttataaacaaagatgaaacagaacacacaggacaggaatcttatgtctggaagatgtatcaagaaaggtgttgggaatttttcccagcaggggattgcttccggaaacagtatgaagaccagctaaattaaactcagacccaatcacctctaaaaaccaaaaccctacccctctctctccctctctcaatttctctgctctcttggaaacattttgctgattttgtgaattgccagcgttgtgtgttttctgggagcatcgaagctctgtttcggaagagctgtttcctcccccatatgctcctgctattattttggtaatgctctgatgcaacattgcaactttatgaaatatttgtatgaaaacaaaaagactgcaaaaaatacactttcaaaagaaaccattcattgcatgtttattatgcaagtttaaatgaacaaagaaaaccttcagaaacaagttgatcaacgtgagagaaatttcatgataattattcatagtaataaagtgtcgtgggcttaattgtatatctggagccagtgtcatccaccaacaatgtgatacaatatgaacttgacagtagttttgggttttgcctcattctttcagccacctgtgatcagttttgttgattaaggacttcttgtcaggccattttttaatatcaaagctgaagcaatatccattcagggatttcatcagttgcgtcacaaaacacggatgataatatacatcactccattttttccattttgagtccttttaaatgtaatgctaacctttacaattaaaaagtcagattcagaatggaaacaaggtcattttgcaaacattggagctcttttattacaagtctgcttgttaattttagaactgtaaaaccgctctgattaaactatttaactaacaaaaaaaaac

SEQ ID NO: 311747 - DNA, 2013 bp, Homo sapiens
aaaccctgaagagcccaagcaatgtggttgtaaaatttgcaaaataagattaaatcttaactgcaatctgttaacactgctgtctcctttcactctttctcctatatcacactttcccacatgttggatggccttggagtggtagccataagcatttttggaattcaactaaaaactgaaggatccttgaggacggcagtacctggcatacctacacagtcagcgttcaacaagtgtttgcaaaggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccagacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgtgcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgt

SEQ ID NO: 311748 - DNA, 2384 bp, Homo sapiens
aaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagtcaaagctaaggcccccgaaaccaggcgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtgtcagcccaattccacactttcccacatgttggatggccttggagtggtagccataagcatttttggaattcaactaaaaactgaaggatccttgaggacggcagtacctggcatacctacacagtcagcgttcaacaagtgtttgcaaaggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccagacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgtgcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgt

SEQ ID NO: 311749 - DNA, 1969 bp, Homo sapiens
cgggagtcttcggggagctatgctgagaccgggtggtgcggaggaagctgcgcagctcccgcttcggcgcgccagcgccccggtccctgtgccgtcgcccgcggcccccgacggctcccgggcttcggcccgcctaggtcttgcctgccttctgctcctgctgctgctgacgctgccggcccgcgtagacacgtcctggtggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccagacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgtgcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctctctttttctctctaccattctcaacctgtattggacagcactgcctcttttgcttacttgctgcctgttcaaactgaggtggaatgcagtggttcccatgcttaacaaatcattaaaacaccctagaacactcctaggatagattaatgt

SEQ ID NO: 311750 - DNA, 1863 bp, Homo sapiens
aaaccctgaagagcccaagcaatgtggttgtaaaatttgcaaaataagattaaatcttaactgcaatctgttaacactgctgtctcctttcactctttctcctatatcacactttcccacatgttggatggccttggagtggtagccataagcatttttggaattcaactaaaaactgaaggatccttgaggacggcagtacctggcatacctacacagtcagcgttcaacaagtgtttgcaaaggtacattggggcactgggggcacgagtgatctgtgacaatatccctggtttggtgagccggcagcggcagctgtgccagcgttacccagacatcatgcgttcagtgggcgagggtgcccgagaatggatccgagagtgtcagcaccaattccgccaccaccgctggaactgtaccaccctggaccgggaccacaccgtctttggccgtgtcatgctcagaagtagccgagaggcagcttttgtatatgccatctcatcagcaggggtagtccacgctattactcgcgcctgtagccagggtgaactgagtgtgtgcagctgtgacccctacacccgtggccgacaccatgaccagcgtggggactttgactggggtggctgcagtgacaacatccactacggtgtccgttttgccaaggccttcgtggatgccaaggagaagaggcttaaggatgcccgggccctcatgaacttacataataaccgctgtggtcgcacggctgtgcggcggtttctgaagctggagtgtaagtgccatggcgtgagtggttcctgtactctgcgcacctgctggcgtgcactctcagatttccgccgcacaggtgattacctgcggcgacgctatgatggggctgtgcaggtgatggccacccaagatggtgccaacttcaccgcagcccgccaaggctatcgccgtgccacccggactgatcttgtctactttgacaactctccagattactgtgtcttggacaaggctgcaggttccctaggcactgcaggccgtgtctgcagcaagacatcaaaaggaacagacggttgtgaaatcatgtgctgtggccgagggtacgacacaactcgagtcacccgtgttacccagtgtgagtgcaaattccactggtgctgtgctgtacggtgcaaggaatgcagaaatactgtggacgtccatacttgcaaagcccccaagaaggcagagtggctggaccagacctgaacacacagatacctcactcatccctccaattcaagcctctcaactcaaaagcacaagatccttgcatgcacaccttcctccaccctccaccctgggctgctaccgcttctatttaaggatgtagagagtaatccatagggaccatggtgtcctggctggttccttagccctgggaaggagttgtcaggggatataagaaactgtgcaagctccctgatttcccgctctggagatttgaagggagagtagaagagatagggggtctttagagtgaaatgagttgcactaaagtacgtagttgaggctccttttttctttcctttgcaccagcttcccgatacttcttggtgtgcaagaggaagggtacctgtagagagcttctttttgtttctacctggccaaagttagatgggacaaagatgaatggcatgtcccttctctgaagtccgtttgagcagaactacctggtaccccgaaagaaaatcttaggctaccacattctattattgagagcctgagatgttagccatagtggacaaggttccattcacatgctcatatgtttataaactgtgttttgtagaagaaaaagaatcataacaatacaaacacacattcattctc

SEQ ID NO: 311751 - DNA, 920 bp, Homo sapiens
tgaccatggatccctggtcagctttgactctcaccaaatgcccaggtgtggaccgatggttgggctggttgtattgatgcttggtaagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgaaaaaacacaccgcgccggccaagaaacacaacagaagaggggcccgccaaacaaataccccccgcgagggggcccaacatctaacgcgaccacacggtttgtggcaaacaggggggccccaataggacgcgcgcaaataagcgcaagaccgggcgcacgacaacacagccgcggagggcaaacaggcacgcggcgatcctggcaagaaacccagctcgcccgggcaatcgggaccaccacaagaattaagcgggataatacactagcgattggtacaacagcatgcgcgggaacctgacaggaataacgaaacacacgcgcg

SEQ ID NO: 311752 - DNA, 2295 bp, Homo sapiens
  misc_feature (1674)..(1674): n is a, c, g, or t
accatgatcttaacaaacttacccagtgggctcgtcattggaaaaccaaatgtgaacttattttatcggtaatcactaatatcagagagactctgcaacacggactaaatccataattttctcaagactaatgattcctacagaaattaacaacggaatagtcaaacatctgtgtttcccaaagtctttctagagattactagctccacagaatgttcaaaggtcctactcggtgaggaaattccacgttcaaataagtttggaaagactgagttaaacaaagttaaagaggatctttaactgcacggcttttcagaacaccctaacgtgcatcatctccaagaagtacttatccaggcagtattttccaaacttatttgacaaaggatactttttaaggaagaggatcaaacaggaatagttcactgtgagcacactttgggaaactcagctctaaatctacattgacattgagttttgtctagttaaggcaatgcaagatgaaaccctgggtccacagtatgtagcacaaaaggttccaacctcagttctaccatctgaacatttatctaatagttaataaaataacaagaaagaatgcaaaaaaaaaaaaaaaaagtcaagggtaggagccttctttagtgaaacagcactaagaacaaagcaaaaagaccataacattttaaaagccattttgggcaggctcaaggagaatgtaatcagcagtatcatcatgagcagctctacagatcattaatgctggtttatttgtcttttcaaaaagaaaagaaaaaggtcttgcaggggatgggcactcagccactggaagacagagagcaaatgtaaacaatttactggctttgaacttatttaataatatgtgggacgggccaatgctgagtccagatgtggatttactgaattgcttttagacaaaactcacatatgcaaacatatgcttgacttgtattgaatgtgtctactccatctttcccctctcctgactctactggacttgttaatgttgaatgattttatttttggtatctcaggacacttctatctctgaaagccggggcatcactacatattgatacccctactggagagaagattgcacggactggtaaatgatgtgtctttcctccttctcccaccattttctctccctctagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacaggtactgtaaataaacaggagagaacagagaaaagtcatgactcaggggtcttcttctcacagggctgagtaatcacaggagctttggatgcaggcaggctggcgctctgatcctgactctttcaattacagactgtgttaccttggacaatttggctaagtccttatgcaaaaaaagtatgatgccatttacttaatagggttgtgaggattaaatgagataattnatataaagcccatagcggaaggcctggcaggtagcaagggcccagcaaatgagagctattcacgttgccattaatgcatcatcatcgttacaattatcatctttttttttttacgttccaaagattcttccttctatctattatctcatcatatctcatctcatcatatcatatctcatcattttatccagagatacacttccttgttctttggccaaatgttcgagctataccaagtagggagataatggagaagcagcacgtctatctatacacattaatatttataaaatgctacatgtgaataatcagtacggtgatcagcaaggataaaggagagagctggcaagattaacatgctactgtttatgaagctctctaactttgatactcataacaactctgaaaggcacctagagtgtccttggagtttaattacctttttccataggagctgtttcaaggagaaaaaaaaaaaagatggttaataatatgactcttaggcccagagtgatggctcacacctgtaatcccagcatttcaggaggctgagacaggaggatcacttgagtccaggagtttgagaccagcctaggcaacatagtaagaccctacctgtgc

SEQ ID NO: 311753 - DNA, 248 bp, Homo sapiens
acacacacacacacacacacacacacacacacccctatgcataatcacacactgttttggcatacaagcctataatttcagggaattcaggttatgaattcctacctggtataacaggatgtgagtctcatctgatttcacacactacaacaaatggttctcaagccagatggagcctgagggtgcaaccgtccttcagctgaatttgaatctgggtgccctgggtagatacagaacaatgtggctgc

SEQ ID NO: 311754 - DNA, 6452 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311755 - DNA, 5633 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311756 - DNA, 3391 bp, Homo sapiens
cgagctcgtacccccatagatggtactctataaggcttgcatcctcgaggcccgggatgtccacagctctgaggctgccaggcaacgtgaggttctgggcttgcctccactttgttgacctcctgcacctgaatgacaaagtgctcataggcattgtcagctgcggtccagttgagtctgaggccatcccagccaacctcagacacggctaaatctcccagctgtgggagatcctctgtgacgacctctacagcaagggttcgagtgctgtggcccctgacctcgccgtgcaggttgactgtgtaaggagtgccagacctgaggcctgggatttccatggaacgcaggctgccaggaaccgtgagattgtgagcctcttccaccaggtcagcctcctggacctgaatagtaaactggtcataggttccatctggcgtggtccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311757 - DNA, 7170 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311758 - DNA, 7866 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgaaaaaacacaccgcgccggccaagaaacacaacagaagaggggcccgccaaacaaataccccccgcgagggggcccaacatctaacgcgaccacacggtttgtggcaaacaggggggccccaataggacgcgcgcaaataagcgcaagaccgggcgcacgacaacacagccgcggagggcaaacaggcacgcggcgatcctggcaagaaacccagctcgcccgggcaatcgggaccaccacaagaattaagcgggataatacactagcgattggtacaacagcatgcgcgggaacctgacaggaataacgaaacacacgcgcg

SEQ ID NO: 311759 - DNA, 1491 bp, Homo sapiens
  misc_feature (37)..(37): n is a, c, g, or t
  misc_feature (77)..(77): n is a, c, g, or t
agcgtgtggagcatgccatgactcgttacaagctganggtggagagggtacagtgggacagcaggtgactccatggnctaccacaatggcagatccttctccacctttgacaaggacacagaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311760 - DNA, 1545 bp, Homo sapiens
  misc_feature (57)..(57): n is a, c, g, or t
  misc_feature (60)..(60): n is a, c, g, or t
tcatcccggcaaacaacgtataaccgttattagtgcattcactggacgacgtgaatnaancttgacatatacatccccacacccacccacataacctccccattatcaatatcctgcaccagaatgtgtgcatttgttacaatcaatgaacctacattgacacatcattatcacccaaaactgggtggtatttttaatccctgtttatcaggtgagaacaccaagacttaaggaggggcaggtgaccacccaaagttacatagcaaattagggatggacagaatggagcctgatgctctctccacagtgccacactccttcctctcacaacgatgccctctttcctgcaatagcttaagtacacccagattcatcgatatgttcataggtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311761 - DNA, 957 bp, Homo sapiens
tgtccaggagggaaatttcagctgagatttctcaggtccatattttctgtctctcccaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311762 - DNA, 6976 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagatctccgtcgactgggatcctctagatataaca

SEQ ID NO: 311763 - DNA, 7147 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagatgtggagagaggctggagatccccattaggactgtccacccacactcgaagccacaaaactgcagggattggggctctcactggtttgtcgcctaactcccgcctaaaaggccacaaatttctggtaaacaggtaacagacctaaacgtaaagtgcatcagtaaaatgaacattatctactgccccgatctctagcctgacac

SEQ ID NO: 311764 - DNA, 5880 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311765 - DNA, 5835 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccggggtaggactgcaggtttcacatgaacctgttctaggctgtggacattggtgtggagaggttctgcaattttttaaaaatatgtaactgggttgattttaagtaaaattatttgtgtattgat

SEQ ID NO: 311766 - DNA, 6014 bp, Homo sapiens
  misc_feature (5393)..(5393): n is a, c, g, or t
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacaggtactgtaaataaacaggagagaacagagaaaagtcatgactcaggggtcttcttctcacagggctgagtaatcacaggagctttggatgcaggcaggctggcgctctgatcctgactctttcaattacagactgtgttaccttggacaatttggctaagtccttatgcaaaaaaagtatgatgccatttacttaatagggttgtgaggattaaatgagataattnatataaagcccatagcggaaggcctggcaggtagcaagggcccagcaaatgagagctattcacgttgccattaatgcatcatcatcgttacaattatcatctttttttttttacgttccaaagattcttccttctatctattatctcatcatatctcatctcatcatatcatatctcatcattttatccagagatacacttccttgttctttggccaaatgttcgagctataccaagtagggagataatggagaagcagcacgtctatctatacacattaatatttataaaatgctacatgtgaataatcagtacggtgatcagcaaggataaaggagagagctggcaagattaacatgctactgtttatgaagctctctaactttgatactcataacaactctgaaaggcacctagagtgtccttggagtttaattacctttttccataggagctgtttcaaggagaaaaaaaaaaaagatggttaataatatgactcttaggcccagagtgatggctcacacctgtaatcccagcatttcaggaggctgagacaggaggatcacttgagtccaggagtttgagaccagcctaggcaacatagtaagaccctacctgtgc

SEQ ID NO: 311767 - DNA, 4431 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacaggtattctagacgaattcactaattcacttcctcccctttgtctctgctcgggaggaatcaaagcactttcttgctttaaactgggatcagctcctaccacattggggaaataccagtgaatcatctctgcttcttcctaaatgtcacatcccttatttggctaagtcctagttgtagcccagttccatggaaaattccacctactcctcctttaaaaaagtgagaggtggcttttctttcaaagtaagtttcagtcacaatatctaaaaagttggaaagcccaacctgtaaatgaagaaaaaatagctctgagctcatgagctcattttaagaacaccaaaggactccccatagcc

SEQ ID NO: 311768 - DNA, 3648 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactggtgagtctgccctgagcttcctccaaactctaggttgattctgaggttagcagatctcctcagccagggtgtcctcacatgagaaagccaaatgcaaaagcaagccactttctccatct

SEQ ID NO: 311769 - DNA, 540 bp, Homo sapiens
gtgactcataatcatcataggaatagtaagacttcttgaaaatgtgacaaaaactatgaatccgctccccaggggtggaaatacacacacacacacacacacacacacacacacacacacccctatgcataatcacacactgttttggcatacaagcctataatttcagggaattcaggttatgaattcctacctggtataacaggatgtgagtctcatctgatttcacacactacaacaaatggttctcaagccagatggagcctgagggtgcaaccgtccttcagctgaatttgaatctgggtgccctgggtagatacagaacaatgtggctgcttaagcctggctgagaacttctgtttcttttgttgcaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtga

SEQ ID NO: 311770 - DNA, 474 bp, Homo sapiens
cctgaatcccagcgtgcaattgcctttttaagtaactcagcaactctgtgtccttatgcagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacaggtatatgaccctcctcccagactggagacatgataggagccagcatgtcattgaaatagagaaaattcacccgtgtggcagaatcctaccccaatgttgttgacagacagcgtgaatctctaactcaggaaggtctgtgt

SEQ ID NO: 311771 - DNA, 7544 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311772 - DNA, 7271 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311773 - DNA, 5906 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311774 - DNA, 3931 bp, Homo sapiens
agaaatatgacattgttgtcctgctggtgttttaatagggacagcaccagtaggggatgcagtgaacaaagcctggcacttggactgcaatggcctatagatgtggcattgggtttgccattcccaggttctcagaagcaaaactttctgaggaatagtttaactgaccccatctctgtcattattcagaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311775 - DNA, 3552 bp, Homo sapiens
accatgatcttaacaaacttacccagtgggctcgtcattggaaaaccaaatgtgaacttattttatcggtaatcactaatatcagagagactctgcaacacggactaaatccataattttctcaagactaatgattcctacagaaattaacaacggaatagtcaaacatctgtgtttcccaaagtctttctagagattactagctccacagaatgttcaaaggtcctactcggtgaggaaattccacgttcaaataagtttggaaagactgagttaaacaaagttaaagaggatctttaactgcacggcttttcagaacaccctaacgtgcatcatctccaagaagtacttatccaggcagtattttccaaacttatttgacaaaggatactttttaaggaagaggatcaaacaggaatagttcactgtgagcacactttgggaaactcagctctaaatctacattgacattgagttttgtctagttaaggcaatgcaagatgaaaccctgggtccacagtatgtagcacaaaaggttccaacctcagttctaccatctgaacatttatctaatagttaataaaataacaagaaagaatgcaaaaaaaaaaaaaaaaagtcaagggtaggagccttctttagtgaaacagcactaagaacaaagcaaaaagaccataacattttaaaagccattttgggcaggctcaaggagaatgtaatcagcagtatcatcatgagcagctctacagatcattaatgctggtttatttgtcttttcaaaaagaaaagaaaaaggtcttgcaggggatgggcactcagccactggaagacagagagcaaatgtaaacaatttactggctttgaacttatttaataatatgtgggacgggccaatgctgagtccagatgtggatttactgaattgcttttagacaaaactcacatatgcaaacatatgcttgacttgtattgaatgtgtctactccatctttcccctctcctgactctactggacttgttaatgttgaatgattttatttttggtatctcaggacacttctatctctgaaagccggggcatcactacatattgatacccctactggagagaagattgcacggactggtaaatgatgtgtctttcctccttctcccaccattttctctccctctagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311776 - DNA, 7849 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttgagtttgttattttgctttgaattgttgagtctgaatttcaccaaagccaatcatttgaacaaagcggggaatgttgggataggaaaggtaagtagggatagtggtcaagtgggaggggtggaaaggagactaaagactgggagagagggaagcactttttttaaataaagttgaacacacttgggaaaagcttacaggccaggcctgtaatcccaacactttgggaggccaaggtgggaggatagcttaaccccaggagtttgagaccagcctgagcaacatagtgagaacttgtctctacagaaa

SEQ ID NO: 311777 - DNA, 1814 bp, Homo sapiens
gaccttggtctccccacggggaaggaaaagattttaagaggagggctttgtaagtggaaaaacagttcccactggccctaaacctagtatttaatgatccacgttccaggcaggaaaatatttttgaagaggcatattttttaggcaatttttcctagatgtttgttaggtttctatacattgagagctttttacaaactatagcaagcagggaaacagaggaaccatcctctctgtcaggacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311778 - DNA, 7370 bp, Homo sapiens
  misc_feature (7345)..(7345): n is a, c, g, or t
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggccagcgggngtctccgccatttgtcgctgccact

SEQ ID NO: 311779 - DNA, 7484 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagagaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatatttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311780 - DNA, 7290 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacgcgagaacttctaccaaaactggaaggcatatgctgctggatttggggaccgcagagaagaattctggcttgggctggacaacctgaacaaaatcacagcccaggggcagtacgagctccgggtggacctgcgggaccatggggagacagcctttgctgtctatgacaagttcagcgtgggagatgccaagactcgctacaagctgaaggtggaggggtacagtgggacagcaggtgactccatggcctaccacaatggcagatccttctccacctttgacaaggacacagattcagccatcaccaactgtgctctgtcctacaaaggggctttctggtacaggaactgtcaccgtgtcaacctgatggggagatatggggacaataaccacagtcagggcgttaactggttccactggaagggccacgaacactcaatccagtttgctgagatgaagctgagaccaagcaacttcagaaatcttgaaggcaggcgcaaacgggcataaattccagggaccactgggtgagatgagcggatcagagtaaacaaaaggaatctcaaaggaaatttgaagaagaaactgtaaaatccaaagtgactgttgatactggagtaattcctgcctctgaagagaaagcagagactcccacagctgcagaagatgacaatgaaggagacaaaaagaagaaagataagaagaacaagaaaggagaaaaaggaagaaaaggagaaagagcagaaaaaaggacctagcaaagccactgttaaagctatgcaagaagctctggctaagcttaaagaggaagaagaacgaccgacgagagaagaggaagaacgtataaaacggcttgacgaattagaagccaagcgttaa

SEQ ID NO: 311781 - DNA, 965 bp, Homo sapiens
acgattaacccaagtctatagaagccggcgtaaagagtgttttagatcaccccctcccccataaagctaaaactcacctgagttgtaaaaaactccagttgacaccaaatagactacgaaagtggctttaacatatctgaacacacaatagtttatgctgtcagcataaactataagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacgaggaataaggcccagagcgaggaaaggattttaccaaagcatcaatacaaccagcccaaccatcggtccacacctgggcatttggtgagagtcaaagctgaccatggatccctggggccaacggcaacagcatgggcctcacctcctctgtgatttctttctttgcaccaaagacatcagtctccaacatgtttctgttttgttgtttgattcagcaaaaatctcccagtgacaacatcgcaatagttttttacttctcttaggtggctctgggaatgggagaggggtaggatgtacaggggtagtttgttttagaaccagccgtattttacatgaagctgtataattaattgtcattatttttgttagcaaagattaaatgtgtcattggaagccatccctttttttacatttcatacaacagaaaccagaaaagcaatactgtttccattttaaggatatgattaatattattaatataataatgatgatgatgatgatgaaaactaaggatttttcaagagatctttctttccaaaacatttctggacagtacctgattgtattttttttttaaataaaagcacaagtacttttga

SEQ ID NO: 311782 - DNA, 6250 bp, Homo sapiens
  misc_feature (6140)..(6140): n is a, c, g, or t
  misc_feature (6159)..(6159): n is a, c, g, or t
  misc_feature (6212)..(6212): n is a, c, g, or t
  misc_feature (6229)..(6230): n is a, c, g, or t
  misc_feature (6235)..(6235): n is a, c, g, or t
  misc_feature (6246)..(6247): n is a, c, g, or t
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaagccgaaccggaagttgacaaccttctggtttcagatgccaccccagacggtttccgtctgtcctggacagctgatgaaggggtcttcgacaattttgttctcaaaatcagagataccaaaaagcagtctgagccactggaaataaccctacttgcccccgaacgtaccagggacttaacaggtctcagagaggctactgaatacgaaattgaactctatggaataagcaaaggaaggcgatcccagacagtcagtgctatagcaacaacagccatgggctccccaaaggaagtcattttctcagacatcactgaaaattcggctactgtcagctggagggcacccacggcccaagtggagagcttccggattacctatgtgcccattacaggaggtacaccctccatggtaactgtggacggaaccaagactcagaccaggctggtgaaactcatacctggcgtggagtaccttgtcagcatcatcgccatgaagggctttgaggaaagtgaacctgtctcagggtcattcaccacagctctggatggcccatctggcctggtgacagccaacatcactgactcagaagccttggccaggtggcagccagccattgccactgtggacagttatgtcatctcctacacaggcgagaaagtgccagaaattacacgcacggtgtccgggaacacagtggagtatgctctgaccgacctcgagcctgccacggaatacacactgagaatctttgcagagaaagggccccagaagagctcaaccatcactgccaagttcacaacagacctcgattctccaagagacttgactgctactgaggttcagtcggaaactgccctccttacctggcgacccccccgggcatcagtcaccggttacctgctggtctatgaatcagtggatggcacagtcaaggaagtcattgtgggtccagataccacctcctacagcctggcagacctgagcccatccacccactacacagccaagatccaggcactcaatgggcccctgaggagcaatatgatccagaccatcttcaccacaattggactcctgtaccccttccccaaggactgctcccaagcaatgctgaatggagacacgacctctggcctctacaccatttatctgaatggtgataaggctcaggcgctggaagtcttctgtgacatgacctctgatgggggtggatggattgtgttcctgagacgcaaaaacggacncgagaacttcaatcagggnaagatcttcaagtgaacatctcttgccatcacctagctgcctgcacctgcccntcagggagatgggggtnnttaanggaaactgaannttg

SEQ ID NO: 311783 - DNA, 5470 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgcctgggctcaaagcagccactcattataccatcaccatccgcggggtcactcaggacttcagcacaacccctctctctgttgaagtcttgacagaggaggttccagatatgggaaacctcacagtgaccgaggttagctgggatgctctcagactgaactggaccacgccagatggaacctatgaccagtttactattcaggtccaggaggctgaccaggtggaagaggctcacaatctcacggttcctggcagcctgcgttccatggaaatcccaggcctcagggctggcactccttacacagtcaccctgcacggcgaggtcaggggccacagcactcgaccccttgctgtagaggtcgtcacagaggatctcccacagctgggagatttagccgtgtctgaggttggctgggatggcctcagactcaactggaccgcagctgacaatgcctatgagcactttgtcattcaggtgcaggaggtcaacaaagtggaggcagcccagaacctcacgttgcctggcagcctcagggctgtggacatcccgggcctcgaggctgccacgccttatagagtctccatctatggggtgatccggggctatagaacaccagtactctctgctgaggcctccacagccaaagaacctgaaattggaaacttaaatgtttctgacataactcccgagagcttcaatctctcctggatggctaccgatgggatcttcgagacctttaccattgaaattattgattccaataggttgctggagactgtggaatataatatctctggtgctgaacgaactgcccatatctcagggctaccccctagtactgattttattgtctacctctctggacttgctcccagcatccggaccaaaaccatcagtgccacagccacgacagaggccctgccccttctggaaaacctaaccatttccgacattaatccctacgggttcacagtttcctggatggcatcggagaatgcctttgacagctttctagtaacggtggtggattctgggaagctgctggacccccaggaattcacactttcaggaacccagaggaagctggagcttagaggcctcataactggcattggctatgaggttatggtctctggcttcacccaagggcatcaaaccaagcccttgagggctgagattgttacaggtatttcaaatcaagtgagccatttgttcctcttcctggtccccttctgtgtaatctgtctaccggatcgccatgactttaacatctttgttcacattccctacttaatccataaatgtagtctactgtttcaccttctccccacactccctcttgtcatatgtacttaatgaacactccccactcccaccccagaaatgagaaggtcgaaatatttctgctttgtattcaaaatcctttagaccttgtcttgtccatagctcttgtgtgcttacctcatatcatcgtcccttgtgatcaacc

SEQ ID NO: 311784 - DNA, 4075 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtgggtgggagtgcagcttccaagaaacaccacttcctatgtcctgagaggcctggaaccaggacaggagtacaatgtcctcctgacagccgagaaaggcagacacaagagcaagcccgcacgtgtgaaggcatccactgaacaagcccctgagctggaaaacctcaccgtgactgaggttggctgggatggcctcagactcaactggaccgcagctgaccaggcctatgagcactttatcattcaggtgcaggaggccaacaaggtggaggcagctcggaacctcaccgtgcctggcagccttcgggctgtggacataccgggcctcaaggctgctacgccttatacagtctccatctatggggtgatccagggctatagaacaccagtgctctctgctgaggcctccacaggggaaactcccaatttgggagaggtcgtggtggccgaggtgggctgggatgccctcaaactcaactggactgctccagaaggggcctatgagtactttttcattcaggtgcaggaggctgacacagtagaggcagcccagaacctcaccgtcccaggaggactgaggtccacagacctgccaagcactagtgtcctgccaagcactagtgtcctgccaagcactagtgtcctgccaagcactagtgtcctgccaagcactagtgtcctgccaa

SEQ ID NO: 311785 - DNA, 3452 bp, Homo sapiens
accggccacagcctgcctactgtcacccgcctctcccgcgcgcagatacacgcccccgcctccgtgggcacaaaggcagcgctgctggggaactcgggggaacgcgcacgtgggaaccgccgcagctccacactccaggtacttcttccaaggacctaggtctctcgcccatcggaaagaaaataattctttcaagaagatcagggacaactgatttgaagtctactctgtgcttctaaatccccaattctgctgaaagtgagataccctagagccctagagccccagcagcacccagccaaacccacctccaccatgggggccatgactcagctgttggcaggtgtctttcttgctttccttgccctcgctaccgaaggtggggtcctcaagaaagtcatccggcacaagcgacagagtggggtgaacgccaccctgccagaagagaaccagccagtggtgtttaaccacgtttacaacatcaagctgccagtgggatcccagtgttcggtggatctggagtcagccagtggggagaaagacctggcaccgccttcagagcccagcgaaagctttcaggagcacacagtagatggggaaaaccagattgtcttcacacatcgcatcaacatcccccgccgggcctgtggctgtgccgcagcccctgatgttaaggagctgctgagcagactggaggagctggagaacctggtgtcttccctgagggagcaatgtactgcaggagcaggctgctgtctccagcctgccacaggccgcttggacaccaggcccttctgtagcggtcggggcaacttcagcactgaaggatgtggctgtgtctgcgaacctggctggaaaggccccaactgctctgagcccgaatgtccaggcaactgtcaccttcgaggccggtgcattgatgggcagtgcatctgtgacgacggcttcacgggcgaggactgcagccagctggcttgccccagcgactgcaatgaccagggcaagtgcgtgaatggagtctgcatctgtttcgaaggctacgccggggctgactgcagccgtgaaatctgcccagtgccctgcagtgaggagcacggcacatgtgtagatggcttgtgtgtgtgccacgatggctttgcaggcgatgactgcaacaagcctctgtgtctcaacaattgctacaaccgtggacgatgcgtggagaatgagtgcgtgtgtgatgagggtttcacgggcgaagactgcagtgagctcatctgccccaatgactgcttcgaccggggccgctgcatcaatggcacctgctactgcgaagaaggcttcacaggtgaagactgcgggaaacccacctgcccacatgcctgccacacccagggccggtgtgaggaggggcagtgtgtatgtgatgagggctttgccggtgtggactgcagcgagaagaggtgtcctgctgactgtcacaatcgtggccgctgtgtagacgggcggtgtgagtgtgatgatggtttcactggagctgactgtggggagctcaagtgtcccaatggctgcagtggccatggccgctgtgtcaatgggcagtgtgtgtgtgatgagggctatactggggaggactgcagccagctacggtgccccaatgactgtcacagtcggggccgctgtgtcgagggcaaatgtgtatgtgagcaaggcttcaagggctatgactgcagtgacatgagctgccctaatgactgtcaccagcacggccgctgtgtgaatggcatgtgtgtttgtgatgacggctacacaggggaagactgccgggatcgccaatgccccagggactgcagcaacaggggcctctgtgtggacggacagtgcgtctgtgaggacggcttcaccggccctgactgtgcagaactctcctgtccaaatgactgccatggccagggtcgctgtgtgaatgggcagtgcgtgtgccatgaaggatttatgggcaaagactgcaaggagcaaagatgtcccagtgactgtcatggccagggccgctgcgtggacggccagtgcatctgccacgagggcttcacaggcctggactgtggccagcactcctgccccagtgactgcaacaacttaggacaatgcgtctcgggccgctgcatctgcaacgagggctacagcggagaagactgctcagaggtgtctcctcccaaagacctcgttgtgacagaagtgacggaagagacggtcaacctggcctgggacaatgagatgcgggtcacagagtaccttgtcgtgtacacgcccacccacgagggtggtctggaaatgcagttccgtgtgcctggggaccagacgtccaccatcatccaggagctggagcctggtgtggagtactttatccgtgtatttgccatcctggagaacaagaagagcattcctgtcagcgccagggtggccacgtacttacctgcacctgaaggcctgaaattcaagtccatcaaggagacatctgtggaagtggagtgggatcctctagacattgcttttgaaacctgggagatcatcttccggaatatgaataaagaagatgagggagagatcaccaaaagcctgaggaggccagagacctcttaccggcaaactggtctagctcctgggcaagagtatgagatatctctgcacatagtgaaaaacaatacccggggccctggcctgaagagggtgaccaccacacgcttggatgcccccagccagatcgaggtgaaagatgtcacagacaccactgccttgatcacctggttcaagcccctggctgagatcgatggcattgagctgacctacggcatcaaagacgtgccaggagaccgtaccaccatcgatctcacagaggacgagaaccagtactccatcgggaacctgaagcctgacactgagtacgaggtgtccctcatctcccgcagaggtgacatgtcaagcaacccagccaaagagaccttcacaacaggcctcgatgctcccaggaatcttcgacgtgtttcccagacagataacagcatcaccctggaatggaggaatggcaaggcagctattgacagttacagaattaagtatgcccccatctctggaggggaccacgctgaggttgatgttccaaagagccaacaagccacaaccaaaaccacactcacaggtctgaggccgggaactgaatatgggattggagtttctgctgtgaaggaagacaaggagagcaatccagcgaccatcaacgcagccacagagttggacacgcccaaggaccttcaggtttctgaaactgcagagaccagcctgaccctgctctggaagacaccgttggccaaatttgaccgctaccgcctcaattacagtctccccacaggccagtggggagactgtaattgaggcggtagcggatcaaattaggccaacggatgtctaccggacga

SEQ ID NO: 311786 - DNA, 7299 bp, Homo sapiens
cgcccggctccgcccagggtctgcggggaacggaaaccgaaagtgcgcggcgccgggcggggccaccgacctgcctgggccgaagccccagcactcgccggcggcagtgaaaggacgcgccggagccggttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagttgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacgatgattgagaaa

SEQ ID NO: 311787 - DNA, 481 bp, Homo sapiens
gttgtactccaccggcgaggtgtactccaccggccggttgtactccagcggaaggttgtactccagccggcagggtgctactcccggagggactcacatggcatgcgtcaccggaacaagaaacaggctatggtcaaagatgtttaatgataactagtgctagtactagtataaatgctttccacgtatttactcctgacaagccaacaatcctataaagagataccattattattcccattttatagaaggtgatactgagggacacagaggttaggtcatttaccttactaggtcccacaacctagtaagaggtagagtagggctttgaagccaggcaaactggctccagagtccttgtttagccactctacagtggaagagctgttgggagaatgtaagacacttgacattaatcagtgatgccagccctttttcttacgtgctgtgacccctgccttgggcttaaaaccaagcctgc

SEQ ID NO: 311788 - DNA, 7390 bp, Homo sapiens
cgcccggctccgcccagggtctgcggggaacggaaaccgaaagtgcgcggcgccgggcggggccaccgacctgcctgggccgaagccccagcactcgccggcggcagtgaaaggacgcgccggagccgggtgagtggccccgcaactgcccctgcccctgattcttccttgcctcgccgcgaaccccggcgcccgcgccgacccgccactgcctctgcccttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagttgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacgatgattgagaaa

SEQ ID NO: 311789 - DNA, 8107 bp, Homo sapiens
cgcccggctccgcccagggtctgcggggaacggaaaccgaaagtgcgcggcgccgggcggggccaccgacctgcctgggccgaagccccagcactcgccggcggcagtgaaaggacgcgccggagccgggtgagtggccccgcaactgcccctgcccctgattcttccttgcctcgccgcgaaccccggcgcccgcgccgacccgccactgcctctgcccttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagcctgacagtaccctgcctggtattgatgtctgcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtaagaaactgtggagaaatttgcctgttgcatctaagttcacttctggtgccagattatctaaggacaggtaaagaggagcttctttggtaggttagaggaaaataccatgaaaagctactgaaagcacccatattttgagaactcttggtgaaattcactcactttcgccaggcgcagtggctcacgcctataatcccaacactttgggaggccaaggcaggtggatcacctgaggtcataagtttgcaatcagcctggccaacatggtgaaatctcgtctctactaaaaatacaaaaattagctgggtgtagtggtgggtgcctgtaatcctggctactcgggaggctggggcacaagaatcacttgaacctgggaggtggaggttgcagtcagctgagatcgcaccactgcactccagcctgggtgacagagtgagactgtctcaaagaaaaaaaaaaaagaaaaaagaaattcactcactttctcctgctgggtttgaaactccaacagtgaccaacacagttttaatgttctggagaccacccagaacactataaggaccagctgtcgctgatgcaggttcagggaagatacagaagtggattcccagaggcccagtggccctgtgggtcctgtgcctcagctcagaggagcctttctcttctttcctcacttgaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagttgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacgatgattgagaaa

SEQ ID NO: 311790 - DNA, 6697 bp, Homo sapiens
  misc_feature (5406)..(5406): n is a, c, g, or t
cgcccggctccgcccagggtctgcggggaacggaaaccgaaagtgcgcggcgccgggcggggccaccgacctgcctgggccgaagccccagcactcgccggcggcagtgaaaggacgcgccggagccgggtgagtggccccgcaactgcccctgcccctgattcttccttgcctcgccgcgaaccccggcgcccgcgccgacccgccactgcctctgcccttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagcctgacagtaccctgcctggtattgatgtctgcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtaagaaactgtggagaaatttgcctgttgcatctaagttcacttctggtgccagattatctaaggacaggtaaagaggagcttctttggtaggttagaggaaaataccatgaaaagctactgaaagcacccatattttgagaactcttggtgaaattcactcactttcgccaggcgcagtggctcacgcctataatcccaacactttgggaggccaaggcaggtggatcacctgaggtcataagtttgcaatcagcctggccaacatggtgaaatctcgtctctactaaaaatacaaaaattagctgggtgtagtggtgggtgcctgtaatcctggctactcgggaggctggggcacaagaatcacttgaacctgggaggtggaggttgcagtcagctgagatcgcaccactgcactccagcctgggtgacagagtgagactgtctcaaagaaaaaaaaaaaagaaaaaagaaattcactcactttctcctgctgggtttgaaactccaacagtgaccaacacagttttaatgttctggagaccacccagaacactataaggaccagctgtcgctgatgcaggttcagggaagatacagaagtggattcccagaggcccagtggccctgtgggtcctgtgcctcagctcagaggagcctttctcttctttcctcacttgaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaaggtgagtctgtcttacccgatctttcttggatggtgtcagcaacctaaaaaggctataatttcctcaagataaaaaagcttttcagcggccaggcgcggtggctcacacctgtaatcccagcactttgggaagctgaggtgggcagatcacttgaggtcagagttcgagaccagcctaactaacatggtgaaaccctgtctctactaaaatacaaaaactagctgagcatggtggcaagcacctgtaatcccagctactcagaaggctgaggtgggagaattgcttgaacccaggaggtggaggttgcagtgagctgagatcgtgccatgctactgcactccaggctgggcagcggagagagactccctgtcaaaaaaaaaaagaaagccttcagaagggagtagagccagctttttaaaagctggttactgggagaaaattgaaatacagaccagggttttttaatcccaattctgcctgttagccatgtaaccttaagcaagttatataagaattctggccaggcgcggtggcttacgcctgtaatcccagagctttgtgaggccgaggcgggcgaatcacaaggtcaagggatcaagaccatcctggccaacatggtgaaatcccatctctactaaaaatacaaaaattagctgggtgcggtggcatgtgcctggctgggtgtggtggctcatgcctataatctcagcactttcggaggccaagatgggtggatcacctgaggtcaggagttggagactagcctggccaacatggtgaaaccccgtctctactaaaaatacaaaaattaactgggcatggtggtgggcgcctgtaatcccagctacttgggaggctgaggcgagaggatcgcttgaacctgggaagtggaggttgtggtgagccaacaagaccgtgccactgtacttcagcctacgcaacaagagtgaactctgtctcaaaaaaaaaaaattgtcagctgaggccaagagttcaaaaccaggctggggcacatagcaagactgtctctttttttaaaataaataaataaattctgagtatcaggttcttctggacaataagaataatggctcctgccatatccttcntttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacgatgattgagaaa

SEQ ID NO: 311791 - DNA, 4982 bp, Homo sapiens
  misc_feature (1)..(1): n is a, c, g, or t
  misc_feature (11)..(11): n is a, c, g, or t
  misc_feature (22)..(22): n is a, c, g, or t
  misc_feature (26)..(26): n is a, c, g, or t
  misc_feature (35)..(35): n is a, c, g, or t
  misc_feature (38)..(38): n is a, c, g, or t
ngaggccaaangggtttttaanaaanagtggaggnttnagaccagggtttatgaggaccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagttgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacgatgattgagaaa

SEQ ID NO: 311792 - DNA, 5812 bp, Homo sapiens
cgcccggctccgcccagggtctgcggggaacggaaaccgaaagtgcgcggcgccgggcggggccaccgacctgcctgggccgaagccccagcactcgccggcggcagtgaaaggacgcgccggagccgggtgagtggccccgcaactgcccctgcccctgattcttccttgcctcgccgcgaaccccggcgcccgcgccgacccgccactgcctctgcccttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagcctgacagtaccctgcctggtattgatgtctgcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagttgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaactgtagttaccagaggtgacaatgtgcggaagaggagttgaagcacttcgttgggcgggttaaggaacatttatgttgggtatagggctgggggagggcatataggagagggaccggg

SEQ ID NO: 311793 - DNA, 3559 bp, Homo sapiens
cgcccggctccgcccagggtctgcggggaacggaaaccgaaagtgcgcggcgccgggcggggccaccgacctgcctgggccgaagccccagcactcgccggcggcagtgaaaggacgcgccggagccgggtgagtggccccgcaactgcccctgcccctgattcttccttgcctcgccgcgaaccccggcgcccgcgccgacccgccactgcctctgcccttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagcctgacagtaccctgcctggtattgatgtctgcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggtactgtgttccacatctagccaacccatgtagggagttcctcttctgttcctagaacattctccacctccaagaccttcaacgatgttaactaattattgattgagcaccaccactgagctgagtgatagggatacagccatgggatagaatagacactttgctctactttcatggagcttatagagtctatccagggtaacaaattaattattaccttcgtggagcctatggagtctatccagggtaacaaattaatcacgtaattccacaaataaaaagttacaaatgggtataaaaactcagaaagaaaagaacagagaggtaacaggcacaatgactcacacctgtaatctcaccactttgggaggctgaggctagaggatctcttgaggcccagggttcaagaccagcctgggcaacatagtgagacctcatctctacaggaaaaa

SEQ ID NO: 311794 - DNA, 2712 bp, Homo sapiens
  misc_feature (1421)..(1421): n is a, c, g, or t
gaaaaatagagatgagggctcactatgttgccaggctggtcttgaaatcctgacctgaagtgatcctcctgccttggcttcccaaagtgatgggattacagatacaagccatcacaactggccctccctaaattttctaacagcaaccttatctttaaagaaattgtccgtgtgtgctctgcccatgtttctaatgacatgcatgtgttttttcagcaccgtatgtgccctgaaattgcccgccttttgaccccccacatttaccaggatctggagaatcatccatctgttcttaagtatgagaagattaaggtgagtctgtcttacccgatctttcttggatggtgtcagcaacctaaaaaggctataatttcctcaagataaaaaagcttttcagcggccaggcgcggtggctcacacctgtaatcccagcactttgggaagctgaggtgggcagatcacttgaggtcagagttcgagaccagcctaactaacatggtgaaaccctgtctctactaaaatacaaaaactagctgagcatggtggcaagcacctgtaatcccagctactcagaaggctgaggtgggagaattgcttgaacccaggaggtggaggttgcagtgagctgagatcgtgccatgctactgcactccaggctgggcagcggagagagactccctgtcaaaaaaaaaaagaaagccttcagaagggagtagagccagctttttaaaagctggttactgggagaaaattgaaatacagaccagggttttttaatcccaattctgcctgttagccatgtaaccttaagcaagttatataagaattctggccaggcgcggtggcttacgcctgtaatcccagagctttgtgaggccgaggcgggcgaatcacaaggtcaagggatcaagaccatcctggccaacatggtgaaatcccatctctactaaaaatacaaaaattagctgggtgcggtggcatgtgcctggctgggtgtggtggctcatgcctataatctcagcactttcggaggccaagatgggtggatcacctgaggtcaggagttggagactagcctggccaacatggtgaaaccccgtctctactaaaaatacaaaaattaactgggcatggtggtgggcgcctgtaatcccagctacttgggaggctgaggcgagaggatcgcttgaacctgggaagtggaggttgtggtgagccaacaagaccgtgccactgtacttcagcctacgcaacaagagtgaactctgtctcaaaaaaaaaaaattgtcagctgaggccaagagttcaaaaccaggctggggcacatagcaagactgtctctttttttaaaataaataaataaattctgagtatcaggttcttctggacaataagaataatggctcctgccatatccttcntttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacgatgattgagaaa

SEQ ID NO: 311795 - DNA, 1396 bp, Homo sapiens
cgcccggctccgcccagggtctgcggggaacggaaaccgaaagtgcgcggcgccgggcggggccaccgacctgcctgggccgaagccccagcactcgccggcggcagtgaaaggacgcgccggagccgggtgagtggccccgcaactgcccctgcccctgattcttccttgcctcgccgcgaaccccggcgcccgcgccgacccgccactgcctctgcccttttccagataacagaaagtaacgtgaaggaattcaggtgactcagacatggaggagagaagacctcatctggatgccaggcccaggaattcccataccaaccacagaggccctgtggatggagagttaccaccaagactgagatcatgccattgcactccagtctgggcgacaggagcaagactctgtctcaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacgatgattgagaaa

SEQ ID NO: 311796 - DNA, 440 bp, Homo sapiens
taccacccccatgactttcatggcatgcattttaggaacaagaaacaggctatggtcaaagatgtttaatgataactagtgctagtactagtataaatgctttccacgtatttactcctgacaagccaacaatcctataaagagataccattattattcccattttatagaaggtgatactgagggacacagaggttaggtcatttaccttactaggtcccacaacctagtaagaggtagagtagggctttgaagccaggcaaactggctccagagtccttgtttagccactctacagtggaagagctgttgggagaatgtaagacacttgacattaatcagtgatgccagccctttttcttacgtgctgtgacccctgccttgggcttaaaaccaagcctgcctcctgacagtaccctgcctggtattgatgtctgcag

SEQ ID NO: 311797 - DNA, 251 bp, Homo sapiens
gtaagacaaaattttttagagtacataagatctgctttgtaagataagcaagggacggagccttcactctaggtttctagaatgtcttcttatttacttattttattttccaacttttattttaggtttaggggtacatgtgcaggtttgttacatgtgtaaattgccatgttgcagaggtttggtgtacagattattttgtcatccaggtaatgagcatagtacctgataggtagttttttgttgtcgtc

SEQ ID NO: 311798 - DNA, 496 bp, Homo sapiens
gaaagagacataatcttttattttcataacttgctgtggccccaaaatgaagcacacaatgactaactaaagaactaaagatagtgatgttgagtggacaaaaagctttccaaggtctctctctggagcagagtaagtggccagtgcatgtcaagagaggaagaaaaaaacaagtgccatgagtgaaccttttaacatgtcacttcttttccctgtcagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcc

SEQ ID NO: 311799 - DNA, 464 bp, Homo sapiens
  misc_feature (20)..(20): n is a, c, g, or t
ttgaagtcagtctggccaancttgccagatccacaaatatcgcgatatttgtggtggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagaaccacaaatatcggggtgcgagc

SEQ ID NO: 311800 - DNA, 7425 bp, Homo sapiens
cgcccggctccgcccagggtctgcggggaacggaaaccgaaagtgcgcggcgccgggcggggccaccgacctgcctgggccgaagccccagcactcgccggcggcagtgaaaggacgcgccggagccgggtgagtggccccgcaactgcccctgcccctgattcttccttgcctcgccgcgaaccccggcgcccgcgccgacccgccactgcctctgcccttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagcctgacagtaccctgcctggtattgatgtctgcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagttgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacgatgattgagaaa

SEQ ID NO: 311801 - DNA, 7184 bp, Homo sapiens
cgcccggctccgcccagggtctgcggggaacggaaaccgaaagtgcgcggcgccgggcggggccaccgacctgcctgggccgaagccccagcactcgccggcggcagtgaaaggacgcgccggagccggttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagttgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacgatgattgagaaa

SEQ ID NO: 311802 - DNA, 7680 bp, Homo sapiens
cgcccggctccgcccagggtctgcggggaacggaaaccgaaagtgcgcggcgccgggcggggccaccgacctgcctgggccgaagccccagcactcgccggcggcagtgaaaggacgcgccggagccgggtgagtggccccgcaactgcccctgcccctgattcttccttgcctcgccgcgaaccccggcgcccgcgccgacccgccactgcctctgcccttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagcctgacagtaccctgcctggtattgatgtctgcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagttgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacgatgattgagaaacaaaaaaaagaagggagaaaaaagaagaaacagacaagaggaacaaaaaaatacaggggaggaggaaaaaaacaggaccaaagaaaaacggggccacaaggggagcaaaacagcggaaaacccagacaccacagaaagaacgtacgcaacaacaggggaggaagaaaacagcgggaacacacaacaaagaggaagacaaagaagaaacatgcgcaggaagcgacggagaaaacccggcaacagaaaacgagggga

SEQ ID NO: 311803 - DNA, 4583 bp, Homo sapiens
  misc_feature (20)..(20): n is a, c, g, or t
ttgaagtcagtctggccaancttgccagatccacaaatatcgcgatatttgtggtggccatgaggctagaccattgtggcactgggacagcagctggacaggagcaagccacaggagagtggcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagcaaccaagaaggcaaggtgggttttctgcagatatccaaccgcatctgtgtggccttgtcccgagccaagaagggaatgtactgcatcggaaacatgcagatgctggccaaggtgcccctgtggagcaagatcattcatacacttcgagagaacaatcaaataggccccatgctccggctctgctgccagaaccaccctgaaacccacaccttagtatccaaagcttctgacttccaaaaagtacccgaaggaggctgcagcctgccctgcgagttccgcctgggctgtgggcatgtctgcacccgtgcctgccacccttatgactcttcacacaaggagttccaatgcatgaagccatgccagaaggtcatctgtcaggaagggcaccggtgtccccttgtttgcttccaggagtgtcagccttgtcaggtgaaggtgcccaaaaccattcctcggtgcggccatgaacaaatggtcccttgttccgtgcctgagtcagatttctgctgccaggagccttgctccaagtctctgagatgtgggcacagatgcagccacccatgtggtgaggactgtgtgcagttgtgttcagaaatggtcaccataaaactcaagtgtgggcacagtcaaccggtaaaatgtggtcatgtggaaggcctcctgtatggtggtctgctagtcaagtgtaccacaaagtgtggcactatcttggactgcgggcatccttgcccaggctcctgccacagctgcttcgaagggcgtttccatgaacgctgtcagcagccctgcaagcgcctgcttatctgctcacacaagtgccaggaaccatgcattggtgagtgcccaccctgccagcggacctgtcagaaccgctgtgtccacagccagtgcaagaagaaatgtggggagctgtgtagtccctgcgtggaaccctgtgtctggcgctgccagcactaccagtgcaccaaactctgctctgagccctgcaaccgacccccatgctatgtgccttgtactaagctgctagtttgtggccacccctgcattggtctctgtggggagccatgccccaagaaatgccggatctgccacatggatgaggtcacccaaatattctttggctttgaggatgagcctgatgcccgctttgtgcagctggaagactgcagccacatctttgaggtgcaagccctagaccgctacatgaatgaacagaaggatgatgaagtcgccatcagattgaaagtctgccctatctgccaggtgcccatccgcaaaaacctgaggtatggaactagcataaaacagcggctagaagagattgaaatcatcaaggaaaagatccagggctcagcaggggaaatagcaaccagccaggaacggcttaaggccctgctggagaggaagagcctcctccaccagctgcttcctgaagacttcctgatgttaaaggagaagctggcccagaaaaatctgtcagtgaaggacctgggtctggttgagaattacatcagcttctatgaccacctggccagcctgtgggattccctgaaaaagatgcatgtcttagaagagaaaagagtgaggactcgactagaacaggtccatgagtggctggccaagaagcgcttgagcttcactagccaggaactaagtgacctccgaagtgaaatccagaggctcacatacctggtgaaccttctgacccgctacaagatagcagagaagaaggtgaaagatagcatagcagtagaggtctatagtgtccagaatatccttgagaaaacatgtaagttcacccaagaggatgaacaacttgtgcaggaaaagatggaagctctgaaagccacccttccctgctctggcctgggcatctcagaggaagagcgagtgcagattgtcagtgccataggttatcctcgtggtcactggttcaagtgccgcaatggccatatctatgtgattggcgattgtgggggagccatggagaggggcacgtgtcctgactgtaaggaagtgattggtggcacaaatcatactctggaaagaagcaaccagcttgcttctgaaatggatggagcccagcatgctgcctggtctgacacggccaacaacctgatgaactttgaggagatccaggggatgatgtaggaagatggtacaccactgccttttgccctcgccactgaatgactggggccagctccctaatgaaggaactgaagtttgttttttattatcatcctttttaggctgggcgcagtggcttacgcctgtaatcccagcactttgggaggccgaggcaggcggatcacgaggtcaggagttcgagaccagcctgaccaacatggcgaaaccccgtctctactaaaaatacaaaaattagctgggcgttatggcgggcgcctgtaatcccagctacttgggaggctgaggcagaagaatcgcttaaacccaggaggcggaggttgcagtgagctgagatcatgccattgcactccagtctgggcgacaggagcaagactctgtctcaaaaaaaaaaaatcattctttttagtcttagcacctacttaaggatccacttttagggctcacccacatttgtttctagatttacccctgcgctagagtaagcactttatctccagaactgagagcaaagttaacaaatctcaccccttctctcctgcaaattagtggacagactccctggaacatgtttggggcttccacctagggccacctagtggtatctctgggtctttacttggtcagatgtttattctacattgttccccaggaacagagtatgagctcattgatgcagaccgattctaattgccaggccctaatttgcagactaactctcataataaacagaggcccatagttgtttatgaactgcttatcccttaaaggagcacaagaacccctccctgccctccttgggcaccctgcctccaggagatggaggcacgtgataagacaaaagactgcaccaactcaccctgacacagttacatagtcactgagagtggggaagatgggacagcccacatgctgcataagatgggccttatgcagcaggcccaggtcgtcattaaggagtgacccctttcctgtaacctgcactttgggatggtagaagtttctttacctgctgacaggtttggtggcactgctggttacccctgggccctgaatggagctaaaatcacatttggtaccagcagcacctatcccaagtgtgatccttcatcccaacactccctcttggagctgttccctgggtagagctagcatgccagcagcttctgcaggctccaaacccaggccagaagccagacccaggcctgctgcctgcatctgcattccctccttccagtgttccttagaacagacatttaggtatctcaggtcctttctaagtgtccctttcctatgtatgcatttcctttttttgtctttactatgcactttagcttataaagccaattaaaaacgatgattgagaaa

SEQ ID NO: 311804 - DNA, 4039 bp, Homo sapiens
cgcccggctccgcccagggtctgcggggaacggaaaccgaaagtgcgcggcgccgggcggggccaccgacctgcctgggccgaagccccagcactcgccggcggcagtgaaaggacgcgccggagccgggtgagtggccccgcaactgcccctgcccctgattcttccttgcctcgccgcgaaccccggcgcccgcgccgacccgccactgcctctgcccttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagcctgacagtaccctgcctggtattgatgtctgcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagatcctacagaaggtggagccgaggattgtcatagtggaagaagctgcggaagtccttgaggcccataccattgccacattgagcaaagcttgccagcacctcattttgattggggaccaccagcagctgcgccccagtgccaacgtgtatgatctggccaagaacttcaaccttgaggtgtccctttttgaacggctagtgaaagtaaacattccctttgtccgtctgaattaccagcaccgtatgtgccctgaaattgcccgccttttgaccccccacatttaccaggatctggagaatcatccatctgttcttaagtatgagaagattaagggggtgtcttccaaccttttctttgtagaacacaactttcctgaacaggaaatccaagagggcaaaagccatcagaaccagcatgaggctcactttgtggtagagctgtgcaagtacttcctgtgccaggaatacctgccttcccagatcaccatcctcactacctataccgggcagctcttctgcctgcgcaaactgatgcctgccaagacatttgctggcgtcagggtccatgttgtggacaaataccaaggggaagagaatgacatcatcctcctctcgctagtgcggagtcataccgtggactagtactagtccacggttggctactagtacacaggttggctaatagtccacaggttggctacatagtccacggttggctactatgtagccaacgtggacatagtagccaaccgtgact

SEQ ID NO: 311805 - DNA, 3306 bp, Homo sapiens
cgcccggctccgcccagggtctgcggggaacggaaaccgaaagtgcgcggcgccgggcggggccaccgacctgcctgggccgaagccccagcactcgccggcggcagtgaaaggacgcgccggagccgggtgagtggccccgcaactgcccctgcccctgattcttccttgcctcgccgcgaaccccggcgcccgcgccgacccgccactgcctctgcccttttccagataacagaaagtaacgtgaaggaattcaggtgactcagacatggaggagagaagacctcatctggatgccaggcccaggaattcccataccaaccacagaggccctgtggatggagagttaccaccaagagctagaaatcaggccaataacccaccagccaatgctctccgaggaggagccagccaccctggaaggcatcctagggccaacaaccatcctgctgcttactggcagagggaagagagatttagggccatgggcaggaacccacatcaaggaaggaggaaccaggaggggcatgccagcgacgaagctagagaccaaagacatgaccaggagaatgacaccaggtggagaaatggcaaccaggactgtaggaaccgcagaccaccatggtccaatgacaacttccagcagtggcggactccccaccagaagcctacagaacagccacagcaggcgaagaaactgggctacaagttcttagaaagtcttctgcagaaagacccttctgaggtggtcatcacacttgccacaagtttagggctgaaagagctcctttctcattcttccatgaaatctaacttccttgagctcatctgtcaggttcttcggaaggcttgtagctccaaaatggatcgccagagtgttctccatgtactgggcatattgaaaaactccaaatttctcaaagtctgcctgcctgcttatgtggtagggatgatcactgaacccatccctgacatccgaaaccagtatccagagcacataagcaacatcatctccctcctccaggaccttgtaagtgtcttccctgccagctctgtgcaggaaacttccatgctggtttccctcctgccaacctctcttaatgctctgagagcctctggtgttgacatagaagaggaaacggagaagaacctggaaaaggtacagactatcattgaacatctgcaggaaaagaggcgagagggcactttgagagtggatacctacactctagtgcagcctgaggcagaagaccatgttgagagctaccgaaccatgcccatttaccctacctacaatgaagtgcacttggatgagaggcccttccttcgccccaatatcatttctggaaaatacgacagcactgctatctatctggatacccacttccggctcctgcgagaagatttcgtcagacctttacgggaaggtattttggaacttctccaaagctttgaagaccagggcctgaggaagagaaagtttgatgacatccgaatctactttgacaccaggattatcacccccatgtgttcatcatcaggcatagtctacaaggtgcagtttgacacaaaaccactgaagtttgttcgctggcagaattccaaacgattgctctatgggtctttggtatgcatgtccaaggacaacttcgagacatttctttttgccaccgtatctaacagggagcaggaagatctctgccgaggaattgtccagctctgcttcaatgagcaaagccaacagctgctagcagaggtccagccctctgactctttcctcatggtagagacaactgcatactttgaggcctacaggcacgtcctggaaggactccaggaggtccaggaggaagatgttcccttccagaggaatatcgtggagtgtaactctcatgtgaaggagccaaggtacttgctaatggggggcagatatgactttacccccttaatagagaatccttcagccactggggaatttctaagaaatgtcgagggtttgagacatcccagaattaatgtcttagatcctggccagtggccctcaaaagaagccctgaagctggatgactcccagatggaagccttgcagtttgctctcacaagggaactggctattattcaaggacctcctggaacaggcaaaacctatgtgggtctaaaaattgttcaggccctcctaaccaacgagtctgtttggcaaattagcctccagaagttccccatcttggttgtgtgttatactaatcatgctttggaccagtttctggaaggcatctacaattgtcagaagaccagcattgtgcgggtgggtggaaggagcaacagtgaaatcctgaagcagttcaccctaagggagctgaggaacaagcgggaattccgccgcaacctccccatgcacctccgaagggcctacatgagtatcatgacacagatgaaggagtcagagcaagagcttcatgaaggagccaagaccctggagtgcaccatgcgtggtgtcctacgggaacagtacctgcagaagtacatctcaccccagcactgggaaagtctcatgaatggaccagtgcaggatagtgaatggatttgcttccagcactggaagcattccatgatgctggagtggctaggtcttggtgtcggttctttcacgcaaagtgtttctccagcaggacctgagaatacagcccaggcagaaggggatgaggaggaagaaggggaggaggagagttcgctgatagagatcgcagaggaagctgacctgattcaagcagaccgggtgattgaggaggaagaggtggtgaggccccagcggcggaagaaggaagagagtggagcagaccaggagttggctaaaatgcttctggccatgaggctagaccattgtggcactgggacagcagctggacaggagcaagccacaggagagtggcagcctgacagtaccctgcctggtattgatgtctgcagacccagcgcaaccagaaaaagaaaatgaaaaaaagagtgaaggatgagcttcgcaaactgaacaccatgactgcagccgaggccaacgagatcgaggatgtttggcacctggacctcagttctcgctggcagctttataggctctggctacagttgtaccaggctgacacccgccggaagatcctcagctatgaacgccagtaccgcacatcagcagaaagaatggccgagctgagactccaggaagacctgcacattcttaaagatgcccaggttgtaggaatgacaaccacaggtgctgccaaataccgccagaaccacaaatatcggggtgcgagc

SEQ ID NO: 311806 - DNA, 542 bp, Homo sapiens
tccagctctcgcgagactttcaggggtcggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaa

SEQ ID NO: 311807 - DNA, 651 bp, Homo sapiens
tccagctctcgcgagactttcaggggtcggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaaggaagtccattgcatggcctttgtttcttcacctttggtctctgagcatgaggaggactgtgtgtgaactgccagcagctgtagccacctgctcacagcctctctgaga

SEQ ID NO: 311808 - DNA, 739 bp, Homo sapiens
  misc_feature (145)..(145): n is a, c, g, or t
atgtgtcaaaacaaagagagtaaagcatgagctgccaggttagaagaaaatttgagaagcaggtcagcagcagtaagtgacagcagcagctagagcagaaaccctggaggtggagaagagatctgttcagtgtttatacacttcntcagccttccccaagtggcaagccccagcctcattcttcagtagtttattctgaggctgggaaagataaagggcctcctccaaaatccagatatgaggaagagctaaggaccagagggaagactaccattactgcagctaacttcatagacgtgatcatcacccggcaaattgcctcggacaaggatgcgagggaacgtggctctcaaagttcagactcttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaa

SEQ ID NO: 311809 - DNA, 834 bp, Homo sapiens
ctcctgagtgcccaatctgcccccaggaccatcctgggtgctttatctttaataatctttccctctagacctgccagttgatttgtgagagatgttactatcctcattcagctgatgagaaagcagactcttaccggggttgagaaacttggcaaggccatgtagttcgtaggctgatgagaaccatgctctccccactcccctgggacgccttcgacaggttttaggaattgttatccaggtcatgatggtttggccctgttccactcgtttcccactcttctccctggaagattggggctggatggcactcttaggaacctaggtagggtgtacatagtcctgttgtgagacagttttaacgtaaacagtgtgataaggttttggcttctggccctttgggtctgacctgatacagcaattagagagggttgtcagaatgccgtctgcacagttttaagctgaatgtccttgctttacaggagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaaggaagtccattgcatggcctttgtttcttcacctttggtctctgagcatgaggaggactgtgtgtgaactgccagcagctgtagccacctgctcacagcctctctgaga

SEQ ID NO: 311810 - DNA, 725 bp, Homo sapiens
ctcctgagtgcccaatctgcccccaggaccatcctgggtgctttatctttaataatctttccctctagacctgccagttgatttgtgagagatgttactatcctcattcagctgatgagaaagcagactcttaccggggttgagaaacttggcaaggccatgtagttcgtaggctgatgagaaccatgctctccccactcccctgggacgccttcgacaggttttaggaattgttatccaggtcatgatggtttggccctgttccactcgtttcccactcttctccctggaagattggggctggatggcactcttaggaacctaggtagggtgtacatagtcctgttgtgagacagttttaacgtaaacagtgtgataaggttttggcttctggccctttgggtctgacctgatacagcaattagagagggttgtcagaatgccgtctgcacagttttaagctgaatgtccttgctttacaggagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaa

SEQ ID NO: 311811 - DNA, 417 bp, Homo sapiens
catctctgcaccaaagcaagagtgaggtcatcacagggaccatgcaagaagaggcgcagctgtgtggcactgaagccggcagccggccttttccaccactccctggctcctcgctttcctggcatcagagctgattgtggggagaaccgaaaggagcagacagagaagcttcaggagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaa

SEQ ID NO: 311812 - DNA, 896 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaaaaaaaacaaaaaaaaaaaaaaaaaaaaaaaaaaaaaaaaaaaaactttggtgggccggcctgtaggcccttggaaaaaagcttttttaaacacaatcctgttttgggcccgggggcccagatgtggtaacgctagcgcggtggcaaaggcgtgtccccagaggaaacccggggccaggacactaggggggggggattcctccccaattaaaaacg

SEQ ID NO: 311813 - DNA, 775 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagatagtagagacggggtttcaccgtgttagccaggatggtctcgatctcctgacctcgtgatccgcccgcctcggcctcccaaagtgctgggattacaggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaa

SEQ ID NO: 311814 - DNA, 949 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaaaaaaaaaaaaaagggggggccggccccttgtatatttaagtataattccacaacaagggacgctcttgggcccccgtgtggcccaggggtgaaggtgccggggcgcaacactacagcatcacgtggaaccctcggaccagcggggtcaagagaatacaacaggcacaaagcctcaccaggatagcggggaactaccggggcaccaaccccgggaatacaggcgtgcaccaacacccccagacaataaggaagctaaggcaaaaagggt

SEQ ID NO: 311815 - DNA, 633 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagataggaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaa

SEQ ID NO: 311816 - DNA, 803 bp, Homo sapiens
  misc_feature (765)..(765): n is a, c, g, or t
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagatagaatcctggtaattgatgtccacccgagaaatccctgcagatgttccagcctctgtctagtccagatagccacaggaagggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaaaaaanaaacatagaatgacaaatgatgaactcagcagcaagat

SEQ ID NO: 311817 - DNA, 1134 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagatagagatggggtttcaccatgttgcccaggctggtcttgaactcagggtccaaacgatccacctaccttggcctcccaacgtgccaggattacaggcatgagccaccacacctggtccatcttgataatttcatactctggcttggcaaagactgaagggaagccatggtgaatgcacagcaacttctgtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaaaaaaaaaaaaaagggggggccggccccttgtatatttaagtataattccacaacaagggacgctcttgggcccccgtgtggcccaggggtgaaggtgccggggcgcaacactacagcatcacgtggaaccctcggaccagcggggtcaagagaatacaacaggcacaaagcctcaccaggatagcggggaactaccggggcaccaaccccgggaatacaggcgtgcaccaacacccccagacaataaggaagctaaggcaaaaagggt

SEQ ID NO: 311818 - DNA, 639 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaa

SEQ ID NO: 311819 - DNA, 798 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagatagagatggggtttcaccatgttgcccaggctggtcttgaactcagggtccaaacgatccacctaccttggcctcccaacgtgccaggattacaggcatgagccaccacacctggtccatcttgataatttcatactctggcttggcaaagactgaagggaagccatggtgaatgcacagcaacttctgtgagtccttctctgtttggttgtcttatacctaaagtgttttgcttccagggttcaccagggttattttcccacctgtttgctgtacgatgactattataatcactcgtgtttagcataggtgttgtatagctgagttaaatagctttcttaagcctgtactttaggcagtggtcctttaaaaaagtaatcttcaaggatcttttcaccctgaggcttgaataatatcttaatagaaaattatcatatgattttgtcctgtaggaagaggcatttatttataaatacccttgcccccattactatcttaagaaaagcagttctaggccaggc

SEQ ID NO: 311820 - DNA, 213 bp, Homo sapiens
cgagaggaaagctggaggcgcgggtggggaacatgtctgagtcggagctcggcaggaagtgggaccggtgtctggcggatgcggtcgtgaagataggtaaggggcttttcgccccagcaggcccggccggtgcagagctgctggctccaggctgcgctgcccaggaggaaggaagggaagccccacgggaggtcaggcctctcggccttttcc

SEQ ID NO: 311821 - DNA, 681 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaa

SEQ ID NO: 311822 - DNA, 274 bp, Homo sapiens
catctctgcaccaaagcaagagtgaggtcatcacagggaccatgcaagaagaggcgcagctgtgtggcactgaagccggcagccggccttttccaccactccctggctcctcgctttcctggcatcagagctgattgtggggagaaccgaaaggagcagacagagaagcttcaggtcttttgcttaaaacatttccattgttccaaactgagttgtcagggataatggctcaggggtgattatatgcatattatgtatttaatggctgggagtt

SEQ ID NO: 311823 - DNA, 760 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagatagaatcctggtaattgatgtccacccgagaaatccctgcagatgttccagcctctgtctagtccagatagccacaggaagggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaa

SEQ ID NO: 311824 - DNA, 1251 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaaaaaaaaaaaaagccgccgattcgcgcggaggcggaggcttgggtgcgtcaagattcaatttcacccgtaacccaccgccatggccgaggaaggcattgctgcctggaggtgtactggccgtaatactgtttacaagaggttctgaagatgccctcatccacgatggctagcacgtggaattcgcgaagctgccaaagccttagacaagcgccaaagcccatctttgtgtgcttgcatcaatgttatgagcccattgttttgtccaagtcgttgggagcgcttggtgctggaaaacccaaatcaaccttaattaaggttggatgacaaccagaactcaggagattgggttggctttgtcacattgacgaaggggaaccccgtaagtggtggtgccgtgctactactagccaatgacgagtccggcaggattctgaagtttcctgcgacatcacgaacctggtcgcgcacacacatacactagccaacaaaaaaaagaaggggcgtctggggcgcgccgtagacaagtatacacgccagacagacgagcgctgaacacatatatgtgttaat

SEQ ID NO: 311825 - DNA, 439 bp, Homo sapiens
  misc_feature (6)..(6): n is a, c, g, or t
  misc_feature (47)..(47): n is a, c, g, or t
  misc_feature (71)..(71): n is a, c, g, or t
tgctancgacccgcagaatggccgtgctgcgatccgcctgaaaaagnactgtttggataggattgtttccnacctacctccttaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaa

SEQ ID NO: 311826 - DNA, 1345 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagatagtagagacggggtttcaccgtgttagccaggatggtctcgatctcctgacctcgtgatccgcccgcctcggcctcccaaagtgctgggattacaggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagagcaggagcagtgacttcacctgagaacatcccagcgggaggacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaaaaaaaaaaaaagccgccgattcgcgcggaggcggaggcttgggtgcgtcaagattcaatttcacccgtaacccaccgccatggccgaggaaggcattgctgcctggaggtgtactggccgtaatactgtttacaagaggttctgaagatgccctcatccacgatggctagcacgtggaattcgcgaagctgccaaagccttagacaagcgccaaagcccatctttgtgtgcttgcatcaatgttatgagcccattgttttgtccaagtcgttgggagcgcttggtgctggaaaacccaaatcaaccttaattaaggttggatgacaaccagaactcaggagattgggttggctttgtcacattgacgaaggggaaccccgtaagtggtggtgccgtgctactactagccaatgacgagtccggcaggattctgaagtttcctgcgacatcacgaacctggtcgcgcacacacatacactagccaacaaaaaaaagaaggggcgtctggggcgcgccgtagacaagtatacacgccagacagacgagcgctgaacacatatatgtgttaat

SEQ ID NO: 311827 - DNA, 825 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttccaggctccatatcttctacatggaaaatatgtcaaagacaagagaaatcatgtttattcctcaggaatactgaagtgccctggagtaagctgccattcttctgtaacaatgttatcagtaatgctttaaactccagcacctggttatgcatttgaaaccaagtctgtttcttgttttgtattttctctctggaagttgtaaggaggtggtcttaaataaattaaacaaaaataggaacatatatcgaacaacacatatctccggtctccccccttcaccacacttccgccccctcctcttttctatctttaaatacgccatctctccttccgggcttaaattgtctctcttgcgctattttccctatgtggagcgtctacattctcattctccgtcgttttacatctctagaccctgttaacg

SEQ ID NO: 311828 - DNA, 512 bp, Homo sapiens
gacagcaggtgtcagttcaagtcatgaaagggttacactatattgacaggcctctccagtaacaagggctgttcacaactgcgaacttcttggctcctcaagattgtaatgtcaacaataaacacacacagttcagctcgtgccgaattcggcacgagcggcacgatggagcgcgggggccggccgagaggaaagctggaggcgcgggtggggaacatgtctgagtcggagctcggcaggaagtgggaccggtgtctggcggatgcggtcgtgaagatagagatggggtttcaccatgttgcccaggctggtcttgaactcagggtccaaacgatccacctaccttggcctcccaacgtgccaggattacaggtgtgaaccagtactttatttctgacaccagatatgtaggagttttcccccacacatcaaccagttctccaactgggtatccggtaactcactttaattctgacaccgtctgcctggagactaccacaagactgccttca

SEQ ID NO: 311829 - DNA, 7731 bp, Homo sapiens
  misc_feature (1594)..(1594): n is a, c, g, or t
  misc_feature (1597)..(1600): n is a, c, g, or t
  misc_feature (1603)..(1603): n is a, c, g, or t
  misc_feature (1607)..(1609): n is a, c, g, or t
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagntannnnctntatnnncatgaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgacttttttttttttggcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaaaggttgtatatta

SEQ ID NO: 311830 - DNA, 9204 bp, Homo sapiens
  misc_feature (1594)..(1594): n is a, c, g, or t
  misc_feature (1597)..(1600): n is a, c, g, or t
  misc_feature (1603)..(1603): n is a, c, g, or t
  misc_feature (1607)..(1609): n is a, c, g, or t
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagntannnnctntatnnncatgaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaagaaggttagtatagcctgaggaaggcagcgtccatgttaggctcacctgtttggaataccagtgtcctgacttccttcaagtcttatgccaagcattcactggagccactggaggttttatattgcattagaaaatgaatttttctatattggtggactgattttttttcctattgagtatttttattataaaaatgttaaaacttcaaggacttagcactaattttgtagtgtttcaaagtgcaagagaaattttacccagaagtgcctcaactgctttaagcagtcttttttggagtgcaatggtagctacaagcaaacgaatcttttcagcagaatgaagcctatttttcagcatattgaagaatatatagcactgaagacttcctggatgacacaagataaacaagttacctctgaattcaagcttcttgatgagcatcataccgatgtgtgccttctaagaaggagtcttgaaaggagttccattttaaagtctccttggtgatcagttctcctgtagttgtgtatattcagtgagcatgcagcttctgttgtatcttcccttggaggtttgtttatacccattgggttcccaacaagttgaaccttgcgttacgataaaagcagatgtggcatccaatcctaccacccagcaaagagaaaccccaggcattcaactgcagcacaaaatcgtgggtgtagccttcttgaagactcagggtagccattccttgctccatatttaattttaattctaaagtcatctaatttcatggaatctttgaatttgcagtacgttgaacttttaaaaaactgtaagttattaattgttcatcaagagcactgtggtggaatatcgtagttgatttctttttctttctttttttttaatgctttctttgtgtgtgggaggtgtgagattcaccatgataggcactttgcagaaaaaaaaagtgattactcttatatattttgttttcttgttaatacaatgccactgaatttttcagctaggatgtgtatattcatattagagttaaaaataaagtaaaatgtgaatcctcccaattaaagaagaactatgaaaaatataaggcaatgttgttcttccacagtgacctccagtattttaaattttttgtggagaaaaaaatgttttgctttcttaaacctcttaactatagcttaagtagagagatatgaacaatgtggcattgacatttatttttaaattctgagcagagaaagatttttatttcttacattgagtacatttaatttagtttttaacattccaattccattacatgtttttttttattgttgatattcatattgataatgacatcatgaaatttatcctcacaagaagtagctggtttatttccaggttacagccatacttcccaaagttcctctgggttctgagaactatgccagctcacctgtcatctccattcattttctacaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgacttttttttttttggcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaaaggttgtatatta

SEQ ID NO: 311831 - DNA, 7812 bp, Homo sapiens
  misc_feature (1594)..(1594): n is a, c, g, or t
  misc_feature (1597)..(1600): n is a, c, g, or t
  misc_feature (1603)..(1603): n is a, c, g, or t
  misc_feature (1607)..(1609): n is a, c, g, or t
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagntannnnctntatnnncatgaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggttacagccatacttcccaaagttcctctgggttctgagaactatgccagctcacctgtcatctccattcattttctacaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgacttttttttttttggcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaaaggttgtatatta

SEQ ID NO: 311832 - DNA, 8235 bp, Homo sapiens
  misc_feature (1594)..(1594): n is a, c, g, or t
  misc_feature (1597)..(1600): n is a, c, g, or t
  misc_feature (1603)..(1603): n is a, c, g, or t
  misc_feature (1607)..(1609): n is a, c, g, or t
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagntannnnctntatnnncatgaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatggggtaacaaaattatattttaatgtgatttacaagactagatgacagaaggattctgaagactttaaaatgttttacagtgttgaagtttatcttctgccttcaggagattatgggagattatgcgatcatgtttccacaggctggtgagagttaccacttctgattatcaacttccggtctatactggatgatagtttttttaaagtcatgtataatatttcttgattgggaggaaatataattttatcatcatagttaacagatcttcaagagtaaaaaaaaaaaagccatcttagtttaaggattagtttatagtgaaattgtaatttttaagaaagctgggcgttctataaaaaccttcaagaacttattaaaaattggtattttttaattctctagaaccacatagtagaatgaataacttgctaattttattcttaaaaacctcatgtttatgttttttgatttgtgtttgtatatttaaacactttgtgcgactttcagctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgacttttttttttttggcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaaaggttgtatatta

SEQ ID NO: 311833 - DNA, 5321 bp, Homo sapiens
  misc_feature (1594)..(1594): n is a, c, g, or t
  misc_feature (1597)..(1600): n is a, c, g, or t
  misc_feature (1603)..(1603): n is a, c, g, or t
  misc_feature (1607)..(1609): n is a, c, g, or t
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagntannnnctntatnnncatgaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaaaggttgtatatta

SEQ ID NO: 311834 - DNA, 6320 bp, Homo sapiens
gaaaatgtgaagccttctggaagacaaattgggaagttgagccacagcaatccaaccattttgtttgattatatcttgtcacaaatacagaagtatgataacttaataacacctgtagtagattcattgaaatacctcacttcactgaattatgatgtcttggcctattgtatcattgaagctttagctaatccagaaaaggaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgacttttttttttttggcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaaaggttgtatatta

SEQ ID NO: 311835 - DNA, 5103 bp, Homo sapiens
  misc_feature (1594)..(1594): n is a, c, g, or t
  misc_feature (1597)..(1600): n is a, c, g, or t
  misc_feature (1603)..(1603): n is a, c, g, or t
  misc_feature (1607)..(1609): n is a, c, g, or t
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagntannnnctntatnnncatgaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttaaaaaaaaatatataatacatccatttctattcttccctcaaactcctcttcaaattccacttaccaccacatctattacccatctcacatcacactactcttccccttctctaacctttattcctacttccacacctatcctcccccatttactaccctctccttctcactatccctaa

SEQ ID NO: 311836 - DNA, 4634 bp, Homo sapiens
  misc_feature (1594)..(1594): n is a, c, g, or t
  misc_feature (1597)..(1600): n is a, c, g, or t
  misc_feature (1603)..(1603): n is a, c, g, or t
  misc_feature (1607)..(1609): n is a, c, g, or t
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagntannnnctntatnnncatgaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggtaatgcacttaatgctttatgtgagatttaaaaagtattttacccatcttaaataaattgtgtttccatcatagtggatacagtgttcagaccct

SEQ ID NO: 311837 - DNA, 4070 bp, Homo sapiens
  misc_feature (1594)..(1594): n is a, c, g, or t
  misc_feature (1597)..(1600): n is a, c, g, or t
  misc_feature (1603)..(1603): n is a, c, g, or t
  misc_feature (1607)..(1609): n is a, c, g, or t
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagntannnnctntatnnncatgaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaaaaaaaaaaacacacaaaaaaaaaaaaaaaaacaaaggggggggcgcaaaaaaaaaactacccccaggggggggcacaatagaacacgttttgaaaaaagggggcccaaaaagggaaaggggcgataaaacacacagcggccggggcgcagaccaaaacaacgcaggcgtaggggaaacagctgttcgccgggacacgtgggcgaggacccaaactacggggggggagacaacaagggagcaccaccaagacaattacagcccgaggggaaaaacacgacgggggataggcgggacaacccacgaacgtgccgacgacagaaatggatacagggatgaatgcacattatcaaggggacaaaaaaggtcgtgaacaacagaaatcactaacacagcaacaagcgacaagccacagggcatacatgaacgagagaaaagcactacagacgaagaaccccacgaacgggacaacgaaccaacggag

SEQ ID NO: 311838 - DNA, 3418 bp, Homo sapiens
tagagtcctgaaggctgagtttggcactgcttcatcactatgcaactttcttcttgatgacagctagctctttctgaagttcagtaaacttgggggcagttttcaagtttgtaatcctaacacctcagcattattttattaaaatactctgtggacactgccaagagactgacatccagtatcttctttccacttgctcttgtggttgctgatttgtcattccaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgacttttttttttttggcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaaaggttgtatatta

SEQ ID NO: 311839 - DNA, 3964 bp, Homo sapiens
  misc_feature (1594)..(1594): n is a, c, g, or t
  misc_feature (1597)..(1600): n is a, c, g, or t
  misc_feature (1603)..(1603): n is a, c, g, or t
  misc_feature (1607)..(1609): n is a, c, g, or t
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagntannnnctntatnnncatgaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatggggtaacaaaattatattttaatgtgatttacaagactagatgacagaaggattctgaagactttaaaatgttttacagtgttgaagtttatcttctgccttcaggagattatgggagattatgcgatcatgtttccacaggctggtgagagttaccacttctgattatcaacttccggtctatactggatgatagtttttttaaagtcatgtataatatttcttgattgggaggaaatataattttatcatcatagttaacagatcttcaagagtaaaaaaaaaaaagccatcttagtttaaggattagtttatagtgaaattgtaatttttaagaaagctgggcgttctataaaaaccttcaagaacttattaaaaattggtattttttaattctctagaaccacatagtagaatgaataacttgctaattttattcttaaaaacctcatgtttatgttttttgatttgtgtttgtatatttaaacactttgtgcgactttcagctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactggtatgcttatttgtagaaacttataagtaatatattttatt

SEQ ID NO: 311840 - DNA, 907 bp, Homo sapiens
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggtaagacatttatctgtatagtatgtgttgttaagataacaagttattttagctattggagaatatccataaagacaaaatgagtgcattccatctattttttttttcagttaaggaatgggagaggtgtttaggcttttacttttaatgggtttatcaataattataaaatttaggcatgatatttgtgaggaaatcttattgtcactataccttgtatgttaatattagggtcctgctctgtctaggtctttcctttttgtggaggggat

SEQ ID NO: 311841 - DNA, 507 bp, Homo sapiens
gcataggcaagtcatttatgaaggaggtaagtaagatttttcttacaaacctaaattttgaaatgaaaatattctgagtatacttgtgttatgagtatctttagaaataaaaatatgaacctcatttaataaagggttatgttgagtgaggtttgtggaaaattccagtgtgtcctaaccatatgcagtcaagtgttgcttaatgacaggtgagaaatgcatcattaggtgattcgtcattgtgcaaacatcagagagtgtacttatacaagcctagatggtatgacctactacatacctagactatatggtatggcccgttactcctaggctacaaacctgtacagaatgttcccgtactgaatactgtggggagttgtaatacactgttaaatatttgtgtatctgaacatatctaaacatttaaaaggtaataccttgcactaagatgttaggacagccatgatatcactaggcaataggaattttttagctctaatataatgt

SEQ ID NO: 311842 - DNA, 331 bp, Homo sapiens
ttggtagagatggggtttcaccacatggtccaggctggtcccaaacttttgggctcaagtcatctgccctcctcggcctcccaaagtgctgggattacaggtgtgagccactgctcccagccattttttgtttttaagtttcacagaagagtgttattatgaaaccctaatacttgctgtgtgcttttttgctatttattgtaattatatttttaaaattaggaatttcgtgaggatatgccctccattcttgctgatgtattctgcatattaggtaggtattaagcctttatttcacctgtaatgtgctgtgcggtaaatcaaatgtttg

SEQ ID NO: 311843 - DNA, 556 bp, Homo sapiens
ccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggtaaagaaaaacgtgtatgtatgtatatttagagattgatttcttaatcttgtttatataatttaatttgttttatttgtaaatgattggtctcatctcaggtgttctagcagaagagatagataaatggatagctaacaatgcaatgtgataagtactatattggtagtatgaatgatgtgatgtgaaagcctagaggaaagaattattaagttttgccttgggagaggtggagtcagggaagactttatagatgtgtctttttttaaacctggtccttgaaggatgaataggagttcattaaggttttctctgcatgagtaacgaacaatgtgagaatcaagatgtggcagtgtgaatatatagagatagaaggaatggttcatagtctgatgtggctgggttgt

SEQ ID NO: 311844 - DNA, 385 bp, Homo sapiens
ccactttaattataagcattatttcttttgaaaaatagaaagtgtagccattacttagttggcacagtagaaatcctttgatcagttaatgccttctattgtttgttgctgttttccagatcttgtcacaaatacagaagtatgataacttaataacacctgtagtagattcattgaaatacctcacttcactgaattatgatgtcttggcctgtatcctttcaagtgaagtaatatgtagatttcatatttaatagatcatatggtaaacgttttattttcattctattttcctttagtaaccatctgaggttgattcaggtggctgatctgaagtttggtcagtcaattgtgtgtgtgtgtgtgtgtgtgtgtgtatgtgaga

SEQ ID NO: 311845 - DNA, 8453 bp, Homo sapiens
  misc_feature (1594)..(1594): n is a, c, g, or t
  misc_feature (1597)..(1600): n is a, c, g, or t
  misc_feature (1603)..(1603): n is a, c, g, or t
  misc_feature (1607)..(1609): n is a, c, g, or t
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagntannnnctntatnnncatgaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaagaaggttagtatagcctgaggaaggcagcgtccatgttaggctcacctgtttggaataccagtgtcctgacttccttcaagtcttatgccaagcattcactggagccactggaggttttatattgcattagaaaatgaatttttctatattggtggactgattttttttcctattgagtatttttattataaaaatgttaaaacttcaaggacttagcactaattttgtagtgtttcaaagtgcaagagaaattttacccagaagtgcctcaactgctttaagcagtcttttttggagtgcaatggtagctacaagcaaacgaatcttttcagcagaatgaagcctatttttcagcatattgaagaatatatagcactgaagacttcctggatgacacaagataaacaagttacctctgaattcaagcttcttgatgagcatcataccgatgtgtgccttctaagaaggagtcttgaaaggagttccattttaaagtctccttggtgatcagttctcctgtagttgtgtatattcagtgagcatgcagcttctgttgtatcttcccttggaggtttgtttatacccattgggttcccaacaagttgaaccttgcgttacgataaaagcagatgtggcatccaatcctaccacccagcaaagagaaaccccaggcattcaactgcagcacaaaatcgtgggtgtagccttcttgaagactcagggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgacttttttttttttggcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaaaggttgtatatta

SEQ ID NO: 311846 - DNA, 7797 bp, Homo sapiens
  misc_feature (1594)..(1594): n is a, c, g, or t
  misc_feature (1597)..(1600): n is a, c, g, or t
  misc_feature (1603)..(1603): n is a, c, g, or t
  misc_feature (1607)..(1609): n is a, c, g, or t
acacatccgggcttctgctactagtgagaggaagatggcggccgcggctgtggtggttcccgcagagtggataaagaactgggagaaatcagggagaggcgaatttttgcatttatgtcggatcctcagtgaaaataaaagccatgatagttcaacatacagagatttccagcaagctctctatgagttgtcatatcatgtaattaaaggaaatctaaagcatgaacaggcatctaatgttcttagtgacattagtgaatttcgtgaggatatgccctccattcttgctgatgtattctgcatattagacattgagacaaattgtttagaagaaaaaagcaagagagactattttacacagttggtattagcatgtttgtatttagtttcagacacagttctaaaggaacgcctggatccagaaacactggaatcattagggcttatcaaacaatcacagcaattcaatcaaaagtcagttaaaatcaagacaaaactcttttataagcagcaaaaattcaatttgttaagagaagagaatgaaggttatgccaagctgattgctgaattggggcaagatttatctggaagtattactagtgatttaatcttagaaaatatcaaatctttaataggatgctttaatctggatcccaatagagttttggatgtcattttagaagtgtttgaatgcaggccagaacacgatgacttctttatatctttgttagaatcttacatgagtatgtgtgaaccgcaaacactgtgtcatattcttgggttcaaattcaagttttaccaggaaccaaatggcgagacaccatcatctttatacagagttgcagcagtacttctacaatttaatcttattgatttagatgatctttatgtacatcttcttccggctgataattgcattatggatgaacacaaacgagaaattgcggaagctaagcaaattgttagaaagcttacgatggttgtgttgtcttctgaaaaaatggatgagcgagagaaagaaaaggaaaaagaagaggagaaagtagagaaaccacctgataaccaaaaacttggcttgttggaagccttattaaagattggtgattggcaacatgcacagaacattatggatcagatgcctccatactatgcagcttcacacaagctaatagcccttgctatttgcaagctcattcatataactattgagcctctctaccgaagagttggagttcctaaaggtgctaaaggctcacctgttaatgctttgcaaaacaagagagcaccaaaacaagctgagagctttgaagatttgaggagagacgtgttcaatatgttctgttaccttggtcctcacctttctcacgatcccattttatttgcaaaagtggtgcgcataggcaagtcatttatgaaggagtttcagtctgatggaagcaaacaagaagataaagaaaaaacggaagttatccttagctgtttgcttagcattactgaccaggtactacttccatctctttctttgatggactgcaatgcttgtatgtctgaggaactatggggaatgtttaaaacatttccatatcagcatagntannnnctntatnnncatgaaagaatgaaacatgatgacacaaccatctcaagctggcttcagagtctggctagtttctgtggtgcagtttttcgtaaatatccaattgatcttgctggtcttcttcagtatgttgccaatcagctaaaggcgggcaaaagttttgacctgcttatattgaaagaagtggtacaaaaaatggcaggaatagaaattacagaggaaatgacaatggagcaactagaggctatgactggtggagagcagctaaaagctgagggtggttattttggtcagatcagaaacactaaaaaatcctctcagagattaaaggatgctctattggaccatgatcttgcccttcctctctgtctgcttatggctcagcagagaaatggggtaatctttcaggaaggtggagagaaacatttgaaacttgtgggaaagctctatgaccagtgtcatgataccctggtgcagtttggtgggtttttagcatctaatctgagcacagaagattatataaagcgagtgccttcaattgatgtactctgtaatgaatttcatacaccccatgatgcagcatttttcctgtctaggccaatgtatgcccatcatatttcgtcaaagtatgatgaacttaaaaaatcagaaaagggaagtaaacagcaacataaagttcataagtacattacatcatgtgagatggtgatggcgcctgtccatgaagcagtggtctccttacatgtttccaaagtctgggatgacatcagccctcaattctatgctacattctggtcattgacaatgtatgaccttgcagttccacacaccagctatgaacgagaagtcaataaacttaaagtccagatgaaagcaattgatgacaatcaggaaatgcccccaaataaaaagaaaaaagagaaggagcgctgtactgcccttcaggacaagcttcttgaagaagaaaagaaacagatggaacatgtacagagagttctacagagattgaaactggaaaaggacaactggcttttagcaaaatctaccaaaaatgagaccatcacaaaatttctacagctgtgtatatttcctcgatgtattttttcagcaattgatgctgtttactgtgctcgttttgttgaattggtacatcaacagaaaactccaaatttttccacacttctttgctatgatcgagttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggtgttgaagtttatcttctgccttcaggagattatgggagattatgcgatcatgtttccacaggctgctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgacttttttttttttggcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaaaggttgtatatta

SEQ ID NO: 311847 - DNA, 5566 bp, Homo sapiens
  misc_feature (147)..(147): n is a, c, g, or t
tagagacagggttttgccatgttgaccaggctggtctcaaactcctggcctcacgtgatttgcctgctttggcctcccaaagtgctggattataggtgtgagccaccgtgcccggctaatacatcttttaaatctgcaattaatgantttgtttatgatttactgggtgacagagtaagactcagtctcaaaacaaaacaaaacaaaacaaaaaacataatgtatgttccagtatgtcagctgcatatttttaatttctatcagcatttcctctgcttactctccccgtaaacccagtaatatgtatggctaagtggttaagaaactattatgtaataaaaaaaaaacaacttattatgtaataataatgataaatttttttttccttgtcactgtaaatcagctttctttataaaagttcttgttttgggtggttgttttatgaatgcattatttccccacaaaagccaaaatctccaaagttctctgcagtgtcattatataaagggaatatacattttgactaggcttacctgtttattatgacttgctgtaagagaatcttctaatatttttaactgattttgaccttgatttgtttatattttttaaacatttttctcctgtaggttttctctgacataatttacacagttgcaagctgtactgaaaatgaagccagtcgatacggaaggtttctttgctgcatgttagagactgtgaccaggtggcatagtgatagagccacatatgaaaaggaatgtggaaactatccaggattccttaccatattacgggcaactggatttgatggtggaaataaggctgatcaattagactatgaaaattttcgacatgttgtacataaatggcattacaaactaaccaaggcatcggtacattgccttgaaacaggcgaatatactcacatcaggaatatcttgattgtgctaacaaaaatacttccttggtacccaaaagttttgaatctgggtcaagctttggaaagaagagtacacaaaatctgccaagaagaaaaagagaagaggccagatctatatgcattggctatgggctactctgggcagttgaaaagtagaaagtcatacatgatacctgaaaatgagtttcatcacaaagacccccctccgaggaatgcagttgccagtgtgcaaaatgggcctggtggtgggccttcttcatcatcaataggaagtgcatctaaatcggatgaaagcagtactgaggagactgataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgacttttttttttttggcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaaaggttgtatatta

SEQ ID NO: 311848 - DNA, 4494 bp, Homo sapiens
tatcacagaacgagtacaatgctggcttagtattactttttattccctagataggagtatataagcgttaagaagtaatcagcttgctgtttctttctaattattctctaatcattttgctctgaaattgtagcttatttacatttaggggcttgttaaataaaaccttacttttatttcagataaatcaagggagagatctcagtgtggtgtgaaagctgttaataaagcttctagtaccacacctaaagggaattcaagcaatggaaatagtggctctaacagcaacaaagctgttaaagaaaatgacaaagaaaaagggaaagagaaagaaaaagagaaaaaagaaaagactccagctactactccagaggccagggtacttggtaaagatggtaaagaaaaaccaaaggaagagcggccaaataaagatgaaaaagcaagagagaccaaggaaagaacgccgaagtctgacaaagagaaagaaaaattcaagaaggaagaaaaagctaaagatgagaaatttaagaccactgtccccaacgcagaatcaaaatcaactcaagaaagggaaaagagagaaggagccatccagagaaagagatatagcaaaggaaatgaaatcaaaggaaaatgttaaaggaggagaaaaaacaccagtttctgggtccttgaaatcacctgttcccagatcagatattccagagcctgaaagggaacaaaaacgccgcaaaattgatactcacccttctccatcacattcctccacagtaaaggacagtctcatcgaactcaaggaatcttcagcaaagctctacattaatcatactcctccaccactgtccaagagtaaggagagagaaatggacaagaaagatttggacaagtcaagggaaagatccagagaaagagagaaaaaagatgaaaaggacaggaaagagcggaaaagggatcactcaaacaacgaccgtgaagtgccaccggacttaaccaagagacgtaaagaggagaatggaacaatgggggtttcaaaacataaaagtgaaagtccttgtgaatctccttatccaaatgagaaagacaaggaaaaaaataagtcaaaatcttcaggcaaagaaaaaggcagtgattcatttaaatctgagaagatggataaaatctcctccggtggcaaaaaggagtccaggcatgataaagaaaagatagaaaagaaagagaaacgggacagttcaggaggaaaggaagagaagaaacatcataagtcctcggacaagcacagataatgaagactttccatcaaggctatggacagaccccctaagccgaaagtctcccagaggaggatgccaaagctccgtgcgtcactctcagaatgatatctcccataattaagagcttctggtgctgtccatttaatgggaatctgctttaagtcagaagatgagtacacaccaccatcctcttgacgagacattccaaagtcactgattttcagaacattattttcacctccaggcagtttcttacagcaaggtccctgtgtatacattttttactcgagatacaccatccagaatcagcatctaatgaaaatttcactgagttttagttcattcttctttctctgaaaggagaggaaatcgcctccaggaaccagttccttaatgacgtagataggccgtctttgtgtgtgaactcctatacttttgacattactgggatgattatattgcttgaggattttggcttctagtaaaaattttaatttcagttcctggggaagacgttcttgacgtgttttaacagcaacagcaattttatcctttaatgtgaccttaaatgtgtcaccaaaatttcccttgcctcttgtaacgtggcacctttatgattgagaacccatttcttattctcctaatggccatactgtgataccatgatgctcttaattggaacattgacttttttttttttggcaatttaaacaattgagataaaattcatataacatcaaatttacctttcacttttttttttttcttttggagaccaagtctcgctgttgtctcccaggctggagtgcagtggcgcgatctcggctcactgtgacctccgcctcctgggttcaagcaattctccttcctcagcctcctgagtagctgggactacaggcgtgcaccaccacgcctggctaatttttgtatttttagtagagataggggtttcaccgtgttagccaggatggtctcgatctcctgacctggtgatccacctgcctcggcctcccaaagtgttgggattataagcgtgagccatgacgcctggcctcaaacttgccatttttaaagtgtacaattcaatggtttttagtatatccactatgttgtgcaagcatcaccgctgtctaattccagagcatttctgtcaccccaaaaagaaactccatgcctattagcagtcactcccagttcttcccttcctcggcccctggaaaccagtaatgtactttctgtctctgtgattttgcctgttttggacatttcatttaaatggaattatgcaataatttgtggccttttgtgtttggctttcacttagcatcatgttctcaaggctcatccatgttgtggcatgtatcagtactgcattcctttttatggctaaatgatgtttcattgtatgagtgtgtaccacattttatttatccattcagcaattaatggacaggaacaatggcttttaagtattaaattgtaagttcaacattaaatgtatccacagttattgataatatcaagattatacatggtgtgaacagaatgctgtgtcgaaatggtatgtaaattatttgtcagcatttcatgtaagtgattattttctaaggacccttctagccctggttttaagaaatatgtgaatgtagtattttcatcaataaagtttaatgcattaagcattagcttaaaatttgaatgaaggcagatgtgaagatatttgccacatgttgtaataatcatgttttgaaattatttcaatatgaagtatttgaaaaatgtcaatacataaaggaaaggaaatgagtataattaagtcaatatatttttaaagcaatttttataatttagcagacactgcatcttaatataagttactattaaaattgtgtccttgtgaaaaatgtgatgtcattttcctttttttgttgatcatgtaaaataggttacttttctttgctacattttctatttaataagctattgcttgccgttgtggaatgttttacttgttgctccatttttttctccctacccccacccctctctcccacacgcacacaatgttcaattttttttttaagtcatcattagtgtgtttatctttaatggattctaagaatggacaaaaagaaacacacaaatatttcatccttttctggggactcaagtctttgttaccgatggaactcattaacttcttgttctttcttaaatcttcctccctccttaccttttcctctccttccttctcttcttcttcctttcttctcccctccctccctccctcccttcttccctccctcctcctttcattctccttctctccttctcccttccttttctcctacctcctttgactaagcctccctcccctactccctcctttccttccttccttccttcttctctatcaatataatcactttgtttctttcaggtgagatcggactggaactgttcggctgcgaccagaaatttattttcctgagtaaattgccgagaattaagaatgaagagggccatttgcatctccttaaattattcagttacctgctttattgctccatgtggaaaacttaaaattgttaagttgtgcattactgtattttaacttgttgcttagtttctacatgtttattttcagtaatggctgaaagtgttaactgttccatacttttagcacaatgtgctgcataaggttacctgtgtacagagttttactttagattaactaaatattgcctgggttcagtttttatttccattctgaaatgcttcctttttattgtttgaaactgaaaataaacaattgttgaacccttttgattttacctcattttaaaactgttttaatttattatttggcttgttcttaatattagtcactaaaagcagtgggagcattgtcttatgaaatgcttaggaatcattttatatagtacatgtacaacattaaacgtgtttaaaaaagaaaaaggtaccagcgatcacttgtcccttgccattttttcttgtaattatgttagacaaatcttggcggcggggggatcaaaacataattgttttaattctacagctgtaggagctttgtattgctgaactttcatctggaaaagtttcacagtgacatttttaaaagagaatttttttatctgccgaattctaccagtgtaaccttttttctaaataaacaatagttttctcaaaaggttgtatatta

SEQ ID NO: 311849 - DNA, 973 bp, Homo sapiens
gaggcagcggtccgggaacccgtgctgccccggccccgccgcccacacctgagcctccgtggcgccccgcccccgcacctatgccgcgtggggcgggggctgcgggcgggggtgcgcggcgccggatgagcctcctggcctcgccgagggtgtacagggggtgggagagtcaggccggggaccgaaacttggctgagcagagcaccagcccctttgtctcctccgccccctcttccccacttcctgcccagctctggatcggcggcgcggcgcggactttgtaaacacttcgccactgcagggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggtaggcttgggtgctggagaaaccggggtagatgggatgtcagctcaggctggagaccatgcgttggggatcggtgctgggtgggtcaatggggtcgccgcatcctcatcacttcctagttggcaccgaaagcttggctcactttcccactgagtgaggtgttctgcacggaattgaagggcagagaaacccccaaaggccctgagccctctgtatgtacacacatcggcacaaccccctccagctgatctggaagccccgtggctttaccgggctgttggtcttctcatgcctcaaagatggggtggaaggccagtaggagggcagaccagtgtggatggggagtctgtgagtgctctggcaagtgcaccgggatgaaactggagggagggacccctcagtggtgtctgattgatacatagatgatgatcttagcttcttctgtgtctcttgaagtgccaacaagaggaataactgaataaattggttgctgttactaaggaa

SEQ ID NO: 311850 - DNA, 2047 bp, Homo sapiens
gccacggttgctacatcgtcgcgaggggcggggcgcctgtcagggaagcggcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagccagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggctt

SEQ ID NO: 311851 - DNA, 3012 bp, Homo sapiens
gccacggttgctacatcgtcgcgaggggcggggcgcctgtcagggaagcggcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggcttaaaaaaaaaaaaaaaaaaaaaaaaaaaaaaaaaaaaaaaaaaaaaaaaaaaggggggggcgcccgaaaaaaaaacccggcgaggggcccccatgttccacggatccccccttctttttggtaaagaaggggccccagaagagagagctgcttataaaaacaacaaacacaggggccacattaaaaacaaacgccgcgccggatggggacaaaaacgtcgcgcggggcaaaatcgtggggggaaagagacaccccatctcgtggggggggcgcacacaagatgtggggacaaccacaccctcaagggacagaattttatacgagacctcacagggggaaaacaatataaacaacctttgacgggctgtataaacggggcgtgtcaaaccacccaacgcgcggtaataatcagtctgccggccgggtatgaagaaaacatttgcggccacacacggggtcattatattctttggaaccaaattttttttcccccgggcggtcttctagctacaaaatatgacggagcgacgaacaaaacggaacgaaccagccaagacaagaagaaggacaaaagtagatagaagggcgagaagagatggagggcaagacgataggcaggagagacgacacaaccaagacagaacgaagagagacagctaattgaccagaacatgaaggacaagtagaacaatgcaacgaaagaaaaaaacagaaaccgagagattaaagagaacaaatcaagaatgagaggcagaaacacaagcaggaacgatgaataagccacaaagcagaaagatgcacgagaagacacaaagaaaaagcaaacaaaaaacaaaaaacagcaacagaagaaaaagaaaaaaaagagaacagaaacacagagaaaagagagagggcaaggagaaagcacaagcaacggagcaacagaacacgaagg

SEQ ID NO: 311852 - DNA, 3056 bp, Homo sapiens
gccacggttgctacatcgtcgcgaggggcggggcgcctgtcagggaagcggcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggcttaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaggggggggcgcccgaaaaaaaaacccggcgaggggcccccatgttccacggatccccccttctttttggtaaagaaggggccccagaagagagagctgcttataaaaacaacaaacacaggggccacattaaaaacaaacgccgcgccggatggggacaaaaacgtcgcgcggggcaaaatcgtggggggaaagagacaccccatctcgtggggggggcgcacacaagatgtggggacaaccacaccctcaagggacagaattttatacgagacctcacagggggaaaacaatataaacaacctttgacgggctgtataaacggggcgtgtcaaaccacccaacgcgcggtaataatcagtctgccggccgggtatgaagaaaacatttgcggccacacacggggtcattatattctttggaaccaaattttttttcccccgggcggtcttctagctacaaaatatgacggagcgacgaacaaaacggaacgaaccagccaagacaagaagaaggacaaaagtagatagaagggcgagaagagatggagggcaagacgataggcaggagagacgacacaaccaagacagaacgaagagagacagctaattgaccagaacatgaaggacaagtagaacaatgcaacgaaagaaaaaaacagaaaccgagagattaaagagaacaaatcaagaatgagaggcagaaacacaagcaggaacgatgaataagccacaaagcagaaagatgcacgagaagacacaaagaaaaagcaaacaaaaaacaaaaaacagcaacagaagaaaaagaaaaaaaagagaacagaaacacagagaaaagagagagggcaaggagaaagcacaagcaacggagcaacagaacacgaagg

SEQ ID NO: 311853 - DNA, 2032 bp, Homo sapiens
ggccagagtcacgaagtcgagtactcgtgcagcctgcggtacatcaggagcggttgctggcactatgtgagaaattaggagctcttgattccgaccgtggatgattggtagcccagagatactgtgctgagtgtgttggaatatcgcttgcaggttagacgaccactggttccagagagcacggaccacgaggaatgctgaggggagtaaccgtgtcgctgcttagctgtgtattcgttctggatcgatgtctgcgaggtacccacagcgtcttctacttcctttgcgtactctaggagatcgagccgctactgcggaatgaatgctggattaacggaatggctggagggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggctt

SEQ ID NO: 311854 - DNA, 1936 bp, Homo sapiens
gaggcagcggtccgggaacccgtgctgccccggccccgccgcccacacctgagcctccgtggcgccccgcccccgcacctatgccgcgtggggcgggggctgcgggcgggggtgcgcggcgccggatgagcctcctggcctcgccgagggtgtacagggggtgggagagtcaggccggggaccgaaacttggctgagcagagcaccagcccctttgtctcctccgccccctcttccccacttcctgcccagctctggatcggcggcgcggcgcggactttgtaaacacttcgccactgcagggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggctt

SEQ ID NO: 311855 - DNA, 1860 bp, Homo sapiens
gccacggttgctacatcgtcgcgaggggcggggcgcctgtcagggaagcggcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggctt

SEQ ID NO: 311856 - DNA, 2123 bp, Homo sapiens
gaggcagcggtccgggaacccgtgctgccccggccccgccgcccacacctgagcctccgtggcgccccgcccccgcacctatgccgcgtggggcgggggctgcgggcgggggtgcgcggcgccggatgagcctcctggcctcgccgagggtgtacagggggtgggagagtcaggccggggaccgaaacttggctgagcagagcaccagcccctttgtctcctccgccccctcttccccacttcctgcccagctctggatcggcggcgcggcgcggactttgtaaacacttcgccactgcagggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagccagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggctt

SEQ ID NO: 311857 - DNA, 587 bp, Homo sapiens
cctcatgtgtgcaactcagaaatggggccaggtctgggaacccatgacgagtggactggggtggagctcccagccttctcccgagacctagtactggcaggtaggcttgggtaggtgaggatagggcttgatccctctggaatcatttggagccatcctgtctggcttggcctctacctatcctcctgaaagtcaagtggcatggggcactacgggttccagctaaagggggtggggtggggtgctatacctcaggacccatccctgatatcctaccaaggggatgtggcttgggttgggcaatctcccctttgaggaacctgagaaaaggctctgtggctgtcattggaggagtcatactcccttctgttgattcaagaagtgtggacttggctgggatgcagagttgcaggggaagctagtggtgatctcccctttcacaaatccttggggttgagagagtctttctgcttcatcccagaagagagcccagttcatggtgatgctgtggtatctgctgcttccgtctttcagccctggctggagaaatcctcagagccctgaatgaagtcaggagaaggcctgga

SEQ ID NO: 311858 - DNA, 2076 bp, Homo sapiens
gccacggttgctacatcgtcgcgaggggcggggcgcctgtcagggaagcggcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggctt

SEQ ID NO: 311859 - DNA, 822 bp, Homo sapiens
  misc_feature (774)..(774): n is a, c, g, or t
  misc_feature (776)..(776): n is a, c, g, or t
  misc_feature (787)..(788): n is a, c, g, or t
gccacggttgctacatcgtcgcgaggggcggggcgcctgtcagggaagcggcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagatttncntttgccatgtnnccgccatcatgaacacacccggggggtcctgcag

SEQ ID NO: 311860 - DNA, 1181 bp, Homo sapiens
gaggcagcggtccgggaacccgtgctgccccggccccgccgcccacacctgagcctccgtggcgccccgcccccgcacctatgccgcgtggggcgggggctgcgggcgggggtgcgcggcgccggatgagcctcctggcctcgccgagggtgtacagggggtgggagagtcaggccggggaccgaaacttggctgagcagagcaccagcccctttgtctcctccgccccctcttccccacttcctgcccagctctggatcggcggcgcggcgcggactttgtaaacacttcgccactgcagggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtgggtgagtgctgggtagctgggcagcagcctctccattcataaagtagtgctatgccctgagcctccagtagagggaaacctccaaccccaacctggtcccaagtcctggtttcacaaccttggggctttgtggctttttatctcctgccttggtctggggaagagcaagtatcttgggtggggtgaagggcactggccc

SEQ ID NO: 311861 - DNA, 2440 bp, Homo sapiens
gccacggttgctacatcgtcgcgaggggcggggcgcctgtcagggaagcggcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggcttaaaaaaaaaaaaaaaaaaaaaaaaaaaaaaaaaaaaaaaaaaaaaaaaaaaaaaaaaaaaaaaaccgaaaagacaacaagacacgaagaagagagatgagagagagagatgagagaggagcagcgagcagagagaaacgcgagacgggaatgatacacgacagagggagaaacacagagggagaggcgtaggggcgctgtcctataggagagaaggggaggggaggggagcgggagggaggagggcggcggcgggaggcgaagagggtgggggcgaggaggggtgagagaggcgacggagcggcgcggagagtcgacgagagaggagagaggaggggagcgcaacgacaggagagggagagtca

SEQ ID NO: 311862 - DNA, 2152 bp, Homo sapiens
gaggcagcggtccgggaacccgtgctgccccggccccgccgcccacacctgagcctccgtggcgccccgcccccgcacctatgccgcgtggggcgggggctgcgggcgggggtgcgcggcgccggatgagcctcctggcctcgccgagggtgtacagggggtgggagagtcaggccggggaccgaaacttggctgagcagagcaccagcccctttgtctcctccgccccctcttccccacttcctgcccagctctggatcggcggcgcggcgcggactttgtaaacacttcgccactgcagggtggagactggctctgttcggatgccggccgggggggagaggtgcaatcctctcctcgcggctggtggttgcgaccacccccactccccaaaggcaggctccggaggcggcgggacagagcgcctgcgaccccagtcggtgctccggggaggtcacctgacgaggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggctt

SEQ ID NO: 311863 - DNA, 2022 bp, Homo sapiens
gccacggttgctacatcgtcgcgaggggcggggcgcctgtcagggaagcggcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggcaagccctgttgacacaggtctttcctaaggctgcaaggtttaggctggtggcccaggaccatcatcctactgtaataaagatgattgtgaaataaaactggctttggctt

SEQ ID NO: 311864 - DNA, 1939 bp, Homo sapiens
gccacggttgctacatcgtcgcgaggggcggggcgcctgtcagggaagcggcgcgcgcgcgggcggcgggcgggctggggatccgccgcgcagtgccagcgccagcgccagacccgcgccccgcgctctccggcccgtcgcctgccttgggactcgcgagcccgcactcccgccctgcctgttcgctgcccgagtatggagctgctgtgttgcgaaggcacccggcacgcgccccgggccgggccggacccgcggctgctgggggaccagcgtgtcctgcagagcctgctccgcctggaggagcgctacgtaccccgcgcctcctacttccagtgcgtgcagcgggagatcaagccgcacatgcggaagatgctggcttactggatgctggaggtatgtgaggagcagcgctgtgaggaggaagtcttccccctggccatgaactacctggatcgctacctgtcttgcgtccccacccgaaaggcgcagttgcagctcctgggtgcggtctgcatgctgctggcctccaagctgcgcgagaccacgcccctgaccatcgaaaaactgtgcatctacaccgaccacgctgtctctccccgccagttgcgggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacaggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggctt

SEQ ID NO: 311865 - DNA, 1568 bp, Homo sapiens
tcctcatgtgtgcaactcagaaatggggccaggtctgggaacccatgacgagtggactggggtggagctcccagccttctcccgagacctagtactggcaggactgggaggtgctggtcctagggaagctcaagtgggacctggctgctgtgattgcacatgatttcctggccttcattctgcaccggctctctctgccccgtgaccgacaggccttggtcaaaaagcatgcccagacctttttggccctctgtgctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggctt

SEQ ID NO: 311866 - DNA, 1341 bp, Homo sapiens
  misc_feature (22)..(23): n is a, c, g, or t
tcggctaggtacgaggcctggnntgtggctacagattatacctttgccatgtacccgccatccatgatcgccacgggcagcattggggctgcagtgcaaggcctgggtgcctgctccatgtccggggatgagctcacagagctgctggcagggatcactggcactgaagtggactgcctgcgggcctgtcaggagcagatcgaagctgcactcagggagagcctcagggaagccgctcagaccagctccagcccagcgcccaaagccccccggggctccagcagccaagggcccagccagaccagcactcctacagatgtcacagccatacacctgtagccctggagaggccctctggagtggccactaagcagaggaggggccgctgccacccacctccctgcctccaggaaccacaccacatctaagcctgaaggggcgtctgttcccccttcacaaagcccaagggatctggtcctacccatccccgcagtgtgcactaaggggcccggccagccatgtctgcatttcggtggctagtcaagctcctcctccctgcatctgaccagcagcgcctttcccaactctagctgggggtgggccaggctgatgggacagaattggatacatacaccagcattccttttgaacgccccccccccacccctgggggctctcatgttttcaactgccaaaatgctctagtgccttctaaaggtgttgtcccttctagggttattgcatttggattggggtccctctaaaatttaatgcatgatagacacatatgagggggaatagtctagatggctcctctcagtactttggaggcccctatgtagtccgtgctgacagctgctcctagagggaggggcctaggcctcagccagagaagctataaattcctctttgctttgctttctgctcagcttctcctgtgtgattgacagctttgctgctgaaggctcattttaatttattaattgctttgagcacaactttaagaggacgtaatggggtcctggccatcccacaagtggtggtaaccctggtggttgctgttttcctcccttctgctactggcaaaaggatctttgtggccaaggagctgctatagcctggggtggggtcatgccctcctctcccattgtccctctgccccatcctccagcagggaaaatgcagcagggatgccctggaggtggctgagcccctgtctagagagggaggcaagccctgttgacacaggtctttcctaaggctgcaaggtttaggctggtggcccaggaccatcatcctactgtaataaagatgattgtgaaataaaactggctttggctt

SEQ ID NO: 311867 - DNA, 1930 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311868 - DNA, 612 bp, Homo sapiens
  misc_feature (607)..(607): n is a, c, g, or t
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttattcgcacactacgacaccggactacttacactgtggacagttacaagancaaac

SEQ ID NO: 311869 - DNA, 2457 bp, Homo sapiens
  misc_feature (2306)..(2306): n is a, c, g, or t
  misc_feature (2322)..(2322): n is a, c, g, or t
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaaaaaaaaaaaaaaaaaactcgagactagttctctctctcctcgtgccgaattcggcacgaggccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagctaataaaaaaaaataaaaacttgagggggggctcggaacccaattcggcctattgntgggtcggtttacaantccactggccctccgctttacaacggtcctgacttggtgccggttggcgtataagcaaagaggccccggccgatcggccttcctaaaggtgggcacctgaatgggaagtgcgacatggtagcgtgaaatttggtt

SEQ ID NO: 311870 - DNA, 2530 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaaaaaaaaaaaaaaaaaaaaaaaaaaaaaaaaaaaaaaaaaaaaaaaaaaaaaaaaaaaaaaaaaaaagaagggggggcggcgcccgatataatacttctccccggagggggcccgacgagtaagtagcactccacgacgatatttgttacaaaaggaggggcccccaaatgagagagggcgtttatataataacagagaggagcgagggcggcgcgatataaacaacggcggtagtagaggaacaacacagcgtccgcaggggaggaatatctgtgtgaggggaaggaaaacacaccccaatcagtggcgggtgggggggggggaaacagaatattgtgggtgggaacaaaaaacaacacgctatacgaaggagagatatatattatataacgccgctccgcggggggagaaaatatatatataaatagaaatctttgagagaggaattaattaggtgggtgtgtgtaaaaacaagcaagggcgcaacaattaagtatatgagtggcgggcgtaagtgaaaaaaaaaaagtaatggtgtgacctactgtgagagtaatggtaatttatttgagtaagaacaatatatatattctctaagca

SEQ ID NO: 311871 - DNA, 2086 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagaccacttgccttatcgggagaacaacaatgaacacaacccaacacccactacacaaatcacaacgacgcgacacaagacacggggcgggcggcgtacacacacgaacacaccaagaaaggggcccccaaaggctagacgggtcacccagggtcacacggaaccaagcggtggccccccaaccgcagagccggtaccacgg

SEQ ID NO: 311872 - DNA, 2494 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtggggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaaaaaaaaaaaaaaaaaaaaaaaaaaaaaaaaaaaaaaaaaaaaaaaaaaaaaaaaaaaaaaaaaaaagaagggggggcggcgcccgatataatacttctccccggagggggcccgacgagtaagtagcactccacgacgatatttgttacaaaaggaggggcccccaaatgagagagggcgtttatataataacagagaggagcgagggcggcgcgatataaacaacggcggtagtagaggaacaacacagcgtccgcaggggaggaatatctgtgtgaggggaaggaaaacacaccccaatcagtggcgggtgggggggggggaaacagaatattgtgggtgggaacaaaaaacaacacgctatacgaaggagagatatatattatataacgccgctccgcggggggagaaaatatatatataaatagaaatctttgagagaggaattaattaggtgggtgtgtgtaaaaacaagcaagggcgcaacaattaagtatatgagtggcgggcgtaagtgaaaaaaaaaaagtaatggtgtgacctactgtgagagtaatggtaatttatttgagtaagaacaatatatatattctctaagca

SEQ ID NO: 311873 - DNA, 1894 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtggggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311874 - DNA, 2381 bp, Homo sapiens
ggtgatctaaggatcgcccctcgatagccgacagcctgactagcccagaaaccacagcttagcgatctgtatcgctaggctggtgggtttctgggtcgcagtgtgttcagggttcgtttaccacatccacttgccaagttgccaatgatcgcgtgtttctcgcaccttggttgctaaggtccctcgctgcaaagaacataagttgccccggtcccgcttgctatgggtacctgattgttagaggcaaccagaggatgctgagggacccctgctgacccctcctatggcttccccttgttccgcgcctctcctaaacctaccgcctccactgcaccactgcacctccctcctaaacctgcctcccagccaaagcgtctcttcccttctcttttcctttctaaacttccctctgccttgtaaatctaaccctccccgcacacacactcacacactgtcgtgtccttcctaactcctcctgagtgttccttcatgccctgaatcccctaggtaggaggaggaggatcgcttgagcccaggaatttgaggctgcagtgagctatgatcgcactattgcactccaacctgggtgacatgagcgagaccctttctctaaaaagtaaaaaagaaagaaacctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311875 - DNA, 2055 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgtaggaggaggaggatcgcttgagcccaggaatttgaggctgcagtgagctatgatcgcactattgcactccaacctgggtgacatgagcgagaccctttctctaaaaagtaaaaaagaaagaaagactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311876 - DNA, 1934 bp, Homo sapiens
agcaaagccactcacatgaggtcttgctcctggggacgggcatggccaggactccaaccccggcagcctgtcccagagccctggagctagccccagtgcagtctctccaccaccccgcacttcctcaggccaccttcctgccacagccttttccccaaacctggtatcaccccctctcctccctccctaatcccacctctcgggcctggccactccaccccaccccttccaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311877 - DNA, 2034 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgccaccttcctgccacagccttttccccaaacctggtatcaccccctctcctccctccctaatcccacctctcgggcctggccactccaccccaccccttccaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311878 - DNA, 1910 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311879 - DNA, 1443 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311880 - DNA, 1089 bp, Homo sapiens
ctggggaagcatgaatatacgtgggagcgggtagaagccgcgcagcgcgtttctcctccggtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311881 - DNA, 1944 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccaggtaagagcccttcttcaagcccccgtcgtcacaggctcccccttccctctcacccttttcctcagagggaacccccactgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaaaaaaaaaaaaaaaaaaaaaaaaaaaaaaaaaaaaaaaaaaaaaaaaaaaaaaaaaaaaaaaaaaaagaagggggggcggcgcccgatataatacttctccccggagggggcccgacgagtaagtagcactccacgacgatatttgttacaaaaggaggggcccccaaatgagagagggcgtttatataataacagagaggagcgagggcggcgcgatataaacaacggcggtagtagaggaacaacacagcgtccgcaggggaggaatatctgtgtgaggggaaggaaaacacaccccaatcagtggcgggtgggggggggggaaacagaatattgtgggtgggaacaaaaaacaacacgctatacgaaggagagatatatattatataacgccgctccgcggggggagaaaatatatatataaatagaaatctttgagagaggaattaattaggtgggtgtgtgtaaaaacaagcaagggcgcaacaattaagtatatgagtggcgggcgtaagtgaaaaaaaaaaagtaatggtgtgacctactgtgagagtaatggtaatttatttgagtaagaacaatatatatattctctaagca

SEQ ID NO: 311882 - DNA, 440 bp, Homo sapiens
tcgcccgccgagctgtgtcttcagagattcacacctacccgccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311883 - DNA, 1104 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagacctgagtcggggatccgggtaggagggtcgggccgcgccggggcctggctgaatgctgcaggccccggggcccaagggtggccgcggtggggcgggaagtagggagcgcttcggggagtgggattctgagggctgttgcttagcgatctgtatcgctaggctggtgggtttctgggtcgcagtgtgttcagggttcgtttaccacatccacttgccaagttgccaatgatcgcgtgtttctcgcaccttggttgctaaggtccctcgctgcaaagaacataagttgccccggtcccgcttgctatgggtacctgattgttagaggcaaccagaggatgctgagggacccctgctgacccctcctatggcttccccttgttccgcgcctctcctaaacctaccgcctccactgcaccactgcacctccctcctaaacctgcctcccagccaaagcgtctcttcccttctcttttcctttctaaacttccctctgccttgtaaatctaaccctccccgcacacacactcacacactgtcgtgtccttcctaactcctcctgagtgttccttcatgccctgaatcccctaggtaggaggaggaggatcgcttgagcccaggaatttgaggctgcagtgagctatgatcgcactattgcactccaacctgggtgacatgagcgagaccctttctctaaaaagtaaaaaagaaagaaagtaagtcagggccagaaacaatggctcatgcttgtaatcccagtactttgggaggccaaggtggttggatcgcttgagcccaggagttcaagaccagcctgggcaaaagcccctactttctccctgtccccctaaatcttcctctccagcctctctgcccctcac

SEQ ID NO: 311884 - DNA, 1977 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagacccctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311885 - DNA, 2251 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaaaaaaaaaaaaaaaaaactcgagactagttctctctctcctcgtgccgaattcggcacgaggccctacgtgagctacctcgcccctgagagcgaggagacgcccctgacggccgcgcagctcttcagcgaagccgtggcgcctgccatcgaaaaggacttcaaggacggtaccttcgaccctgacaacctggaaaagtacggcttcgagcccacacaggagggaaagctcttccagctctaccccaggaacttcctgcgctagctgggcgggggaggggcggcctgccctcatctcatttctattaaacgcctttgccagct

SEQ ID NO: 311886 - DNA, 2434 bp, Homo sapiens
  misc_feature (2434)..(2434): n is a, c, g, or t
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaaaaaaaaaaaaaaaaaaaaaaaaaaaaaaaaaaaaaaaaaaaaaaaaaaaaaaaaaaaaaaaaaaaagggggggggaaaaaacccccggggggggccaaaccccccccattttgtgtttcaaagaagggggcccccaaaagggagggcgagttaataaataagcaaagagagaagagggccgcagataaaacaacgctgggagagagggaaaaaaaagctgggacggggagaaacttgctgtgggagaggaacacctttctttggggtgggggggggccaatgatgtgggggcaccaaaattctactcaagaggatagatatatgagaggtgtagagggaaaatatataaaacatattatggaagggtgagttattgtggttggttaacaaacaaagcgtgtatattatactctggcgagttgtgagaaaatattggtggtacgacgggagtatttatatgttgagaaaatttttttttagcgagggcgtgttatgtaaagcggn

SEQ ID NO: 311887 - DNA, 1782 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311888 - DNA, 2688 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagacctgagtcggggatccgggtaggagggtcgggccgcgccggggcctggctgaatgctgcaggccccggggcccaagggtggccgcggtggggcgggaagtagggagcgcttcggggagtgggattctgagggctgttgcttagcgatctgtatcgctaggctggtgggtttctgggtcgcagtgtgttcagggttcgtttaccacatccacttgccaagttgccaatgatcgcgtgtttctcgcaccttggttgctaaggtccctcgctgcaaagaacataagttgccccggtcccgcttgctatgggtacctgattgttagaggcaaccagaggatgctgagggacccctgctgacccctcctatggcttccccttgttccgcgcctctcctaaacctaccgcctccactgcaccactgcacctccctcctaaacctgcctcccagccaaagcgtctcttcccttctcttttcctttctaaacttccctctgccttgtaaatctaaccctccccgcacacacactcacacactgtcgtgtccttcctaactcctcctgagtgttccttcatgccctgaatcccctaggtaggaggaggaggatcgcttgagcccaggaatttgaggctgcagtgagctatgatcgcactattgcactccaacctgggtgacatgagcgagaccctttctctaaaaagtaaaaaagaaagaaacctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311889 - DNA, 2102 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgtaggaggaggaggatcgcttgagcccaggaatttgaggctgcagtgagctatgatcgcactattgcactccaacctgggtgacatgagcgagaccctttctctaaaaagtaaaaaagaaagaaacctctcaccctctggagacccaggcagggaaggtgcaggaggctcaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311890 - DNA, 2081 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagacccctctcaccctctggagacccaggcagggaaggtgcaggaggctcaggccaccttcctgccacagccttttccccaaacctggtatcaccccctctcctccctccctaatcccacctctcgggcctggccactccaccccaccccttccaggactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311891 - DNA, 2000 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagtttcctcatctgtgatctggggatagcagtggtctctccccgacgcggctgctgtgacggttccctggggccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311892 - DNA, 1758 bp, Homo sapiens
  misc_feature (18)..(18): n is a, c, g, or t
  misc_feature (28)..(28): n is a, c, g, or t
  misc_feature (36)..(36): n is a, c, g, or t
  misc_feature (39)..(39): n is a, c, g, or t
  misc_feature (64)..(64): n is a, c, g, or t
  misc_feature (73)..(74): n is a, c, g, or t
  misc_feature (80)..(80): n is a, c, g, or t
  misc_feature (89)..(89): n is a, c, g, or t
  misc_feature (91)..(91): n is a, c, g, or t
  misc_feature (95)..(95): n is a, c, g, or t
  misc_feature (101)..(101): n is a, c, g, or t
  misc_feature (106)..(107): n is a, c, g, or t
  misc_feature (110)..(110): n is a, c, g, or t
  misc_feature (115)..(115): n is a, c, g, or t
  misc_feature (117)..(117): n is a, c, g, or t
  misc_feature (123)..(123): n is a, c, g, or t
  misc_feature (125)..(125): n is a, c, g, or t
  misc_feature (133)..(133): n is a, c, g, or t
  misc_feature (136)..(136): n is a, c, g, or t
  misc_feature (138)..(138): n is a, c, g, or t
  misc_feature (153)..(153): n is a, c, g, or t
  misc_feature (160)..(160): n is a, c, g, or t
  misc_feature (162)..(162): n is a, c, g, or t
  misc_feature (165)..(165): n is a, c, g, or t
  misc_feature (177)..(178): n is a, c, g, or t
  misc_feature (182)..(183): n is a, c, g, or t
  misc_feature (185)..(185): n is a, c, g, or t
  misc_feature (187)..(187): n is a, c, g, or t
  misc_feature (199)..(199): n is a, c, g, or t
  misc_feature (201)..(202): n is a, c, g, or t
  misc_feature (204)..(204): n is a, c, g, or t
  misc_feature (206)..(206): n is a, c, g, or t
  misc_feature (214)..(214): n is a, c, g, or t
  misc_feature (219)..(219): n is a, c, g, or t
  misc_feature (223)..(223): n is a, c, g, or t
  misc_feature (227)..(228): n is a, c, g, or t
  misc_feature (231)..(231): n is a, c, g, or t
  misc_feature (234)..(235): n is a, c, g, or t
  misc_feature (241)..(242): n is a, c, g, or t
  misc_feature (265)..(265): n is a, c, g, or t
  misc_feature (285)..(285): n is a, c, g, or t
  misc_feature (294)..(294): n is a, c, g, or t
  misc_feature (303)..(303): n is a, c, g, or t
  misc_feature (306)..(306): n is a, c, g, or t
  misc_feature (314)..(314): n is a, c, g, or t
  misc_feature (328)..(329): n is a, c, g, or t
  misc_feature (333)..(333): n is a, c, g, or t
  misc_feature (339)..(339): n is a, c, g, or t
  misc_feature (348)..(348): n is a, c, g, or t
agacccctctcaccctcnggccgacccnggccggcnccngtgccggcggctccggcctcagccntccccctcnncgggcngcgccgccngnggcnccgccnccctnnccntcctncngccctncntctcccanccncnccgcctgggcccccngccggcncntcncccggccgcccnncccnngncnggggtgcgcccngnncntnccgagcgnccgcngtcnccgnntcntcnntctggnnggacgccggactctccccatccnccgcctccccgcctttcgcnctccatccnccggcctcnctncccccctngcgccgtcccaccnncccngccccnaggccatcnttgagctcccctatttccacaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccagtcggaccctttcctggggatgattatgggcctcggaggaggcatggactttgactccaagaaggcctacagggacgtggcctggctgggtgaatgcgaccagggctgcctggcccttgctgagctccttggatggaagaaggagctggaggaccttgtccggagggagcacgccagcatagatgcccagtcgggggcgggggtccccaaccccagcacttcagcttcccccaagaagtccccgccacctgccaaggacgaggccaggacaacagagagggagaaaccccagtgacagctgcatctcccaggcgggatgccgagctcctcagggacagctgagccccaaccgggcctggccccctcttaaccagcagttcttgtctggggagctcagaacatcccccaatctcttacagctccctccccaaaactggggtcccagcaaccctggcccccaaccccagcaaatctctaacacctcctagaggccaaggcttaaacaggcatctctaccagccccactgtctctaaccactcctgggctaaggagtaacctccctcatctctaactgcccccacggggccagggctaccccagaacttttaactcttccaggacagggagcttcgggcccccactctgtctcctgcccccgggggcctgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311893 - DNA, 1344 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcagccctttgcctccctcatcagcaaggcacccctctccacccctcgcctgctcatcaacaaggagaaagctggccaggtaagagcccttcttcaagcccccgtcgtcacaggctcccccttccctctcacccttttcctcagagggaacccccactgtggctaagtaaaccatacctaacctaccccagtgtgggtgtgggcctctgaatataacccacacccagcgtagggggagtctgagccgggagggctcccgagtctctgccttcagctcccaaagtgggtggtgggcccccttcacgtgggacccacttcccatgctggatgggcagaagacattgcttattggagacaaattaaaaacaaaaacaactaacaa

SEQ ID NO: 311894 - DNA, 1061 bp, Homo sapiens
gcgctctggcacgtgttgtacgaaagcgcgtctgcggccgcaatgtctgctgagagttgtagttctgtgccctatcacggccactcccatttctggtgccgtcacgggacagagcagtcggtgacaggacagagcagtcggtgacgggacacagtggttggtgacgggacagagcggtcggtgacagcctcaagggcttcagcaccgcgcccatggcagagccagaccgactcagattcagactctgagggaggagccgctggtggagaagcagacatggacttcctgcggaacttattctcccagacgctcagcctgggcagccagaaggagcgtctgctggacgagctgaccttggaaggggtggcccggtacatgcagagcgaacgctgtcgcagagtcatctgtttggtgggagctggaatctccacatccgcaggcatccccgactttcgctctccatccaccggcctctatgacaacctagagaagtaccatcttccctacccagaggccatctttgagatcagctatttcaagaaacatccggaacccttcttcgccctcgccaaggaactctatcctgggcagttcaagccaaccatctgtcactacttcatgcgcctgctgaaggacaaggggctactcctgcgctgctacacgcagaacatagataccctggagcgaatagccgggctggaacaggaggacttggtggaggcgcacggcaccttctacacatcacactgcgtcagcgccagctgccggcacgaatacccgctaagctggatgaaagagaagatcttctctgaggtgacgcccaagtgtgaagactgtcagagcctggtgaagcctgatatcgtcttttttggtgagagcctcccagcgcgtttcttctcctgtatgcagtcagacttcctgaaggtggacctcctcctggtcatgggtacctccttgcaggtgcttggctcctcataggaggcaccctttcaaccttgctggtctcacagggaaagtggcagtggaccttctgggggatatggcccgagggctggatgggc

SEQ ID NO: 311895 - DNA, 923 bp, Homo sapiens
  misc_feature (862)..(862): n is a, c, g, or t
tgtgtgtgttcctctagagtgccaaaaaagaaaaaaaaaagtgctgaagagtcctagggagatgaggctatttttgtttgaagctgatacttctagctgagccacaagtgctgcttggaaagggcttaggttgtttccaggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaggaaaatacaaactaaaggtttcccacaagaacgaaaggcagaacagttgagaaagaaactgaagaagntccaggaaaatggaaaagaaaccgaaaaagaaggggagaaaagaacttgggaaggggaata

SEQ ID NO: 311896 - DNA, 1908 bp, Homo sapiens
  misc_feature (23)..(23): n is a, c, g, or t
  misc_feature (1672)..(1672): n is a, c, g, or t
aagcagtggtatcaacgcagagngcccattacggccgggggagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacagtggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagagaaaaagaagatatcaaaaagaaaagtgagaaggaaactgccattgatgtggaaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaagtaaaaaagctgtacctggaaagaaggaagagaaaacaaccaagacagtggagccagaaattagacaacgaaacatctgcgacgacttctccaattcttgaagataaagaacttattagggcacgaccagaaagtccaggtncctaaggaaaagaactggaattaagaagatgaaagatgtccaagcggaagaagtcagctaaactccaaatacggggaaaggaggagccgagcccataaaagaagaacggttttggaggcttccacggatttgaccaaatggttctggacccaaaatctgggaatgggtaaaagcggcaaaaaaaaaggggggcgataaatgggggaagaatctgcgatgggaccgcggcaattggg

SEQ ID NO: 311897 - DNA, 832 bp, Homo sapiens
  misc_feature (63)..(63): n is a, c, g, or t
  misc_feature (69)..(69): n is a, c, g, or t
  misc_feature (71)..(71): n is a, c, g, or t
  misc_feature (83)..(83): n is a, c, g, or t
cacacacacacactcatccctcccttcccctcaagaacaaaaagacctcagtagtcaacaaanataagnanctaaaaagaagnaaacaacctgaaaggaaaatacaaactaaaagttggacacagctcttgagtacggattgactaagcgaaccatgactgaactggctctgtgtttctatctgctgaaggttaaacagaaactcaactggttccacaccatttgggtccctgctgtttttttcttgcagactgtgctattaatttaataacagtgctgctggagtggcggtagtaatgtagatggcaccatttgcattttggacctggctatattagaattctgatgtcaaagaccgagcagtgggctgtagagtaggtttattaaactagcaagtcttccataattaagacagtgaatttggctgaagtctaaaataaatttctcaaagactgagctggagattatcaacctgaatatatttcttgagtagaccaaatatgttttgtaaaagtaactatttcttaagaaagtgaaagtagagcttcagttgctccacactgagctggaaatcagagagagcttatgttttccacagtttttctgtgtgaatatgaacaaaagatttcactttattgcttagtttcccgtctgtaaatggggtagactaatgcctgctctttattctcaaatagttcagtgaaaataaatgttttgctttacaactgctcttgtatgtggataaatactgttttctgtatgccatgttccatgtcagttatggttgtatgtgatggatagttaggaatttaagttattatcaaagcatttt

SEQ ID NO: 311898 - DNA, 1531 bp, Homo sapiens
tgtgtgtgttcctctagagtgccaaaaaagaaaaaaaaaagtgctgaagagtcctagggagatgaggctatttttgtttgaagctgatacttctagctgagccacaagtgctgcttggaaagggcttaggttgtttccaggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaggaaaatacaaactaaagaagttggacacagctcttgagtacggattgactaagcgaaccatgactgaactggctctgtgtttctatctgctgaaggttaaacagaaactcaactggttccacaccatttgggtccctgctgtttttttcttgcagactgtgctattaatttaataacagtgctgctggagtggcggtagtaatgtagatggcaccatttgcattttggacctggctatattagaattctgatgtcaaagaccgagcagtgggctgtagagtaggtttattaaactagcaagtcttccataattaagacagtgaatttggctgaagtctaaaataaatttctcaaagactgagctggagattatcaacctgaatatatttcttgagtagaccaaatatgttttgtaaaagtaactatttcttaagaaagtgaaagtagagcttcagttgctccacactgagctggaaatcagagagagcttatgttttccacagtttttctgtgtgaatatgaacaaaagatttcactttattgcttagtttcccgtctgtaaatggggtagactaatgcctgctctttattctcaaatagttcagtgaaaataaatgttttgctttacaactgctcttgtatgtggataaatactgttttctgtatgccatgttccatgtcagttatggttgtatgtgatggatagttaggaatttaagttattatcaaagcatttt

SEQ ID NO: 311899 - DNA, 1574 bp, Homo sapiens
tgtgtgtgttcctctagagtgccaaaaaagaaaaaaaaaagtgctgaagagtcctagggagatgaggctatttttgtttgaagctgatacttctagctgagccacaagtgctgcttggaaagggcttaggttgtttccaggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacagtggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagggttcccaggtcctgggatcagaaactccagctattactgccagtacatcaaagggcaaatcaatgcatggaatgacctgaggactagcctccttcccattccctacctctcctgtgggaaaatgtgctccaatttcaacaactaaaatacatctaaatttttggaactttatgagttttggcctgcccttatttaggtattaatgaaaaagattatatttttatatcttcttcaataactatatttattttttaaagacctaacagaatttcataataaaatggattcctctaaaaatgctgttactactctaaaaagaacgagatttacaaaaatccttagaggtgtatctgtttagtaacaagctttgttatttcatatgtttgatatgcataatttggagcaattaagaatgtaacatgttgcttaaattcaataaactctcttggtcct

SEQ ID NO: 311900 - DNA, 1326 bp, Homo sapiens
tgtgtgtgttcctctagagtgccaaaaaagaaaaaaaaaagtgctgaagagtcctagggagatgaggctatttttgtttgaagctgatacttctagctgagccacaagtgctgcttggaaagggcttaggttgtttccaggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacagtggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggtattccaagcaattcttgtacttgtctgttttaatagtctttgtttctaagattgtgggctttttatgtacctaactgtattttcattttttaaaaattgcataatgcatgtgtagatctagaataaaaccaataaaaagcggta

SEQ ID NO: 311901 - DNA, 1666 bp, Homo sapiens
tgtgtgtgttcctctagagtgccaaaaaagaaaaaaaaaagtgctgaagagtcctagggagatgaggctatttttgtttgaagctgatacttctagctgagccacaagtgctgcttggaaagggcttaggttgtttccaggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaggaaaatacaaactaaagattggtcagccaattcttcaacaatcagaacattgaagctcactcagttgaaacctatttatatttgtacttaggaaactaatgtctccttactgttctctttccttttttcggttcttaattcctttgatcacaaagttggacacagctcttgagtacggattgactaagcgaaccatgactgaactggctctgtgtttctatctgctgaaggttaaacagaaactcaactggttccacaccatttgggtccctgctgtttttttcttgcagactgtgctattaatttaataacagtgctgctggagtggcggtagtaatgtagatggcaccatttgcattttggacctggctatattagaattctgatgtcaaagaccgagcagtgggctgtagagtaggtttattaaactagcaagtcttccataattaagacagtgaatttggctgaagtctaaaataaatttctcaaagactgagctggagattatcaacctgaatatatttcttgagtagaccaaatatgttttgtaaaagtaactatttcttaagaaagtgaaagtagagcttcagttgctccacactgagctggaaatcagagagagcttatgttttccacagtttttctgtgtgaatatgaacaaaagatttcactttattgcttagtttcccgtctgtaaatggggtagactaatgcctgctctttattctcaaatagttcagtgaaaataaatgttttgctttacaactgctcttgtatgtggataaatactgttttctgtatgccatgttccatgtcagttatggttgtatgtgatggatagttaggaatttaagttattatcaaagcatttt

SEQ ID NO: 311902 - DNA, 297 bp, Homo sapiens
gtaacttttcaatttattatttccataactaaattctttttactctgaaagattaatttttgggtaacagatagttggatatttgtaaacttttatcatttatattaaaaagttaatttggtcttacctttaaaatttaatatctaaaagaataattaaactgaacacttaatagagaatctcataatgtgagaggaaaatgaagagctccatcatatgtggtagacagaattttgagccccataaccctcattcaccccttggtgtcatccctatggctatgttatattacatggc

SEQ ID NO: 311903 - DNA, 2020 bp, Homo sapiens
  misc_feature (1784)..(1784): n is a, c, g, or t
tgtgtgtgttcctctagagtgccaaaaaagaaaaaaaaaagtgctgaagagtcctagggagatgaggctatttttgtttgaagctgatacttctagctgagccacaagtgctgcttggaaagggcttaggttgtttccaggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacagtggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagagaaaaagaagatatcaaaaagaaaagtgagaaggaaactgccattgatgtggaaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaagtaaaaaagctgtacctggaaagaaggaagagaaaacaaccaagacagtggagccagaaattagacaacgaaacatctgcgacgacttctccaattcttgaagataaagaacttattagggcacgaccagaaagtccaggtncctaaggaaaagaactggaattaagaagatgaaagatgtccaagcggaagaagtcagctaaactccaaatacggggaaaggaggagccgagcccataaaagaagaacggttttggaggcttccacggatttgaccaaatggttctggacccaaaatctgggaatgggtaaaagcggcaaaaaaaaaggggggcgataaatgggggaagaatctgcgatgggaccgcggcaattggg

SEQ ID NO: 311904 - DNA, 1941 bp, Homo sapiens
  misc_feature (23)..(23): n is a, c, g, or t
  misc_feature (1705)..(1705): n is a, c, g, or t
aagcagtggtatcaacgcagagngcccattacggccgggggagggcttaggttgtttccaggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacagtggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagagaaaaagaagatatcaaaaagaaaagtgagaaggaaactgccattgatgtggaaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaagtaaaaaagctgtacctggaaagaaggaagagaaaacaaccaagacagtggagccagaaattagacaacgaaacatctgcgacgacttctccaattcttgaagataaagaacttattagggcacgaccagaaagtccaggtncctaaggaaaagaactggaattaagaagatgaaagatgtccaagcggaagaagtcagctaaactccaaatacggggaaaggaggagccgagcccataaaagaagaacggttttggaggcttccacggatttgaccaaatggttctggacccaaaatctgggaatgggtaaaagcggcaaaaaaaaaggggggcgataaatgggggaagaatctgcgatgggaccgcggcaattggg

SEQ ID NO: 311905 - DNA, 1383 bp, Homo sapiens
tgtgtgtgttcctctagagtgccaaaaaagaaaaaaaaaagtgctgaagagtcctagggagatgaggctatttttgtttgaagctgatacttctagctgagccacaagtgctgcttggaaagggcttaggttgtttccaggggagaactctgcagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaaggaaatgcatctacaaccacaactgtgatagacagcaaaaatggatctgtgcccaaatcccccggaaaagtgctgaagaggacagtcacagaagacatagtgacgacgttcagctcccctgcagcctggcttctggtcattgccctgataatcacgtggtcagctgttgccatcgttatgtttgatttagtggattacaaaaacttttcagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacagtggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaagaaggggaccaagaagaggtgagaagaagtacttctgaaacaaaaaagaagaaacgagactatcaagaaggagaggaacgctggtgggaaaaagagcggaagttgaacaaaaggcggaatg

SEQ ID NO: 311906 - DNA, 1698 bp, Homo sapiens
  misc_feature (23)..(23): n is a, c, g, or t
  misc_feature (1462)..(1462): n is a, c, g, or t
aagcagtggtatcaacgcagagngcccattacggccgggggagaggagaggcaaagttcaacaggacaacaaagaagcagcagaaacagccaggaaaacgaagagcccccaggttttgacacagaaccctccaccagagttctcaaatccccaaatactctgcaaagtgcaacttgacgggaacttttcaactgacttttacttttgacgaccaccatgactgagatcactgctgaagcaagctctattgccaagattggctcagatcctttaaaactggtacgtgatgctatggaggaaaccacggactggatctatggcttcttttctttgttatctgacatcatctcatctgaagatgaagaagatgatgatggtgacgaagatactgataaaggagaaatagatgagcctcccttgagaaaaaaagaaatacacaaagataagactgaaaaacaagagaaacctgaaggaaaatacaaactaaagttacacacaaagaaaaagaaaaaggaaaagaaaaagtaagagaaaaagaaaaacctgaaaagaaagcaactcacaaggaaaaaattgagaaaaaagaaaaaccagaaacaaagacagtggcgaaagaacagaagaaagctaagactgcagaaaagagtgaagaaaagactaaaaaggaagtgaaaggtggaaaacaggagaaagtgaagcaaacagctgcaaaagtaaaagaagtacagaaaacaccatcaaaacccaaagaaaaggaggacaaagagaaagcagctgtgtcaaagcatgaacagaaagatcagtatgcattctgtcgatatatgattgacatatttgtccatggggatttaaaaccaggacaaagcccagccattccacctcccttaccgacagaacaagcttccagacccactccggcatcacctgcccttgaagaaaaagaaggggaaaagaagaaggctgagaagaaagttacttctgaaacaaaaaagaaagagaaaaagaagatatcaaaaagaaaagtgagaaggaaactgccattgatgtggaaaaaaaaagagccgggaaaagcttctgaaaccaaacaagggactgtaaaaattgcagcacaagcagcagctaagaaggatgaaaagaaggaagattccaagaaaacaaaaaaacctgcagaagtagaacaacccaagggaaaaaaacaggaaaagaaagaaaaacatgtggaaccagcaaagtcaccaaagaaagaacactcagttccaagtgacaaacaagtaaaagcaaaaactgaacgagccaaagaggagattggtgcggtttcaagtaaaaaagctgtacctggaaagaaggaagagaaaacaaccaagacagtggagccagaaattagacaacgaaacatctgcgacgacttctccaattcttgaagataaagaacttattagggcacgaccagaaagtccaggtncctaaggaaaagaactggaattaagaagatgaaagatgtccaagcggaagaagtcagctaaactccaaatacggggaaaggaggagccgagcccataaaagaagaacggttttggaggcttccacggatttgaccaaatggttctggacccaaaatctgggaatgggtaaaagcggcaaaaaaaaaggggggcgataaatgggggaagaatctgcgatgggaccgcggcaattggg

SEQ ID NO: 311907 - DNA, 710 bp, Homo sapiens
acgaaaagcgcgcgcggggattccaggagtcgtggtttcttgccttgatgtactggagcaatcagatcacacggcggcttggagaaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcgg

SEQ ID NO: 311908 - DNA, 660 bp, Homo sapiens
ggtcagaggccacgcccccggaagcggcggtgcagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcgg

SEQ ID NO: 311909 - DNA, 772 bp, Homo sapiens
ggcacgaggaagcggcggtgcaggtttcttgccttgatgtactggagcaatcagatcacacggcggcttggagagtgagtgcaaggttttatgagtggaattagccctcagcagatgggggagccagaaggcagttggagtgggaagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcgg

SEQ ID NO: 311910 - DNA, 747 bp, Homo sapiens
ggcacgaggaagcggcggtgcaggtttcttgccttgatgtactggagcaatcagatcacacggcggcttggagagtgagtgcaaggttttatgagtggaattagccctcagcagatgggggagccagaaggcagttggagtgggaagaacccagggaccatgggcgcctccaggctctataccctggtgctggtcctgcagcctcagcgagttctcctggcggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcgg

SEQ ID NO: 311911 - DNA, 828 bp, Homo sapiens
ggtcagaggccacgcccccggaagcggcggtgcagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcgggggtttttttttttttttttggaaatggagtctctctctgttgcccaggctggagtgcaatggcacgatctcggctcacgtcaacctccgcctcccaggttcaagcgatcctcccatctcagcctcccgaagaggtgggattacaggcgcacattgccacacccaact

SEQ ID NO: 311912 - DNA, 775 bp, Homo sapiens
cccagagcaagcgtcccagggccccggcggtcgtaactaccgctgcatgggctctgatgctcagccgcggaaaagcaagtaaccgggaatgaaggaagtggggtcagtcccaaccctgccacgtgcgggtctcgagacggtggacaagtggctggactccactgggcctgggctgtcactggtacacagagggcactgggctagaactgcgttcctcccaccagaggctccacaccatctccgggcccctccccagagcctctcaaccaaaatcagtgtcttcaaagttcaagttgattctgaagctcagccagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcgg

SEQ ID NO: 311913 - DNA, 990 bp, Homo sapiens
acgaaaagcgcgcgcggggattccaggagtcgtggtgaccagggaggggagccgggccagcgggcggcaggagactaggggagctgagccatgggcttgggggagagcggggccgggagctcgaaggagaccagaagagccgggggtttgggagagagacaaggagagcggggcggaggcttgggggagaccaggagtaaatcacaaaaatttactttggaaaccgtggcttctggcagaaacagatcagtgtcgggacaaagtacacgggcctggtgtgaaactaagccacaaacccatttaccctgtctgacctgcctccgccaccaggacccagtctcagtgaaatgggaaaggttcccttgtcctcctcgaagggcgtgcgatgaggatgtggctcacttcttcagtgccccgcttctcaagcctctaggggaacatacagacaggcaggctgaggggctcccaccccacggcagtgtctaggggtgaatgtttgcagctcctgaagccccagcaggcatgtgttagagggtgctctttcagtttagccttgtaggtggcttgtgttagtcagctgttagactccctgccttatcgcaaggacagagggctttctgtatccctaggtttcttgccttgatgtactggagcaatcagatcacacggcggcttggagaaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagtccctgcagtttaagctgaggaggcatcgcttaaatcagaccatttagaccaggcatggtggctcacacctgaaatcccagcactttgggaggccaaagcagaaggatcgcttgagcccaggagttcaggaccagcctgggcaaca

SEQ ID NO: 311914 - DNA, 318 bp, Homo sapiens
ggcacgaggaagcggcggtgcaggtttcttgccttgatgtactggagcaatcagatcacacggcggcttggagagtgagtgcaaggttttatgagtggaattagccctcagcagatgggggagccagaaggcagttggagtgggaagaacccagggaccatgggcgcctccaggctctataccctggtgctggtcctgcagcctcagcgagttctcctgggcatgaaaaagcgaggcttcggggcggcattgagtggcgcagagccgggtttcatctggaattaactggatggaagggaaaataaagctatctagcgg

SEQ ID NO: 311915 - DNA, 236 bp, Homo sapiens
agctcaagcccaactttaattagccatctgtatgaataaatgctgattccaggtccgtttcctctccagtccctgcagtttaagctgaggaggcatcgcttaaatcagaccatttagaccaggcatggtggctcacacctgaaatcccagcactttgggaggccaaagcagaaggatcgcttgagcccaggagttcaggaccagcctgggcaacatagcaagaccctgtctctaca

SEQ ID NO: 311916 - DNA, 903 bp, Homo sapiens
gctgtggggagcatgtcccgagaaggcgcaggaagaggcccaggccacgtgtcccgtgtggtcagcctggggaccagagttaaaaccagagctcctccttcaggaaacagatcatagaagcctgtggtttcatcctgtgttctcagagaagaggcaccaggctggaaagacatttctttgggcagacaggcccagagtatagggcccaggttcccagagcaagcgtcccagggccccggcggtcgtaactaccgctgcatgggctctgatgctcagccgcggaaaagcaagtaaccgggaatgaaggaagtggggtcagtcccaaccctgccacgtgcgggtctcgagacggtggacaagtggctggactccactgggcctgggctgtcactggtacacagagggcactgggctagaactgcgttcctcccaccagaggctccacaccatctccgggcccctccccagagcctctcaaccaaaatcagtgtcttcaaagttcaagttgattctgaagctcagccaggtcgggaccagataatgcattctaggggacatcctcctgggtctcccatccaccctggtggctccctgggctgtgtgtagatgcccagctcctcctccctgccatcgtgtgggcatggcaccatgccctgacggcctccctcccctgcccacctctgcccgcagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacggtgagtctcacagggcctgctccccctccccactatgcgggtcccatctcctggctgggagaaaggc

SEQ ID NO: 311917 - DNA, 783 bp, Homo sapiens
acgaaaagcgcgcgcggggattccaggagtcgtggtttcttgccttgatgtactggagcaatcagatcacacggcggcttggagagtgagtgcaaggttttatgagtggaattagccctcagcagatgggggagccagaaggcagttggagtgggaagaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcgg

SEQ ID NO: 311918 - DNA, 546 bp, Homo sapiens
ctagaggatccccgcatcacaacattgcaagacagcattcagggacccccgtggagagcgatgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcgggggtttttttttttttttttggaaatggagtctctctctgttgcccaggctggagtgcaatggcacgatctcggctcacgtcaacctccgcctcccaggttcaagcgatcctcccatctcagcctcccgaagaggtgggattacaggcgcacattgccacacccaact

SEQ ID NO: 311919 - DNA, 1305 bp, Homo sapiens
acgaaaagcgcgcgcggggattccaggagtcgtggtgaccagggaggggagccgggccagcgggcggcaggagactaggggagctgagccatgggcttgggggagagcggggccgggagctcgaaggagaccagaagagccgggggtttgggagagagacaaggagagcggggcggaggcttgggggagaccaggagtaaatcacaaaaatttactttggaaaccgtggcttctggcagaaacagatcagtgtcgggacaaagtacacgggcctggtgtgaaactaagccacaaacccatttaccctgtctgacctgcctccgccaccaggacccagtctcagtgaaatgggaaaggttcccttgtcctcctcgaagggcgtgcgatgaggatgtggctcacttcttcagtgccccgcttctcaagcctctaggggaacatacagacaggcaggctgaggggctcccaccccacggcagtgtctaggggtgaatgtttgcagctcctgaagccccagcaggcatgtgttagagggtgctctttcagtttagccttgtaggtggcttgtgttagtcagctgttagactccctgccttatcgcaaggacagagggctttctgtatccctaggtttcttgccttgatgtactggagcaatcagatcacacggcggcttggagaaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcgg

SEQ ID NO: 311920 - DNA, 1473 bp, Homo sapiens
acgaaaagcgcgcgcggggattccaggagtcgtggtgaccagggaggggagccgggccagcgggcggcaggagactaggggagctgagccatgggcttgggggagagcggggccgggagctcgaaggagaccagaagagccgggggtttgggagagagacaaggagagcggggcggaggcttgggggagaccaggagtaaatcacaaaaatttactttggaaaccgtggcttctggcagaaacagatcagtgtcgggacaaagtacacgggcctggtgtgaaactaagccacaaacccatttaccctgtctgacctgcctccgccaccaggacccagtctcagtgaaatgggaaaggttcccttgtcctcctcgaagggcgtgcgatgaggatgtggctcacttcttcagtgccccgcttctcaagcctctaggggaacatacagacaggcaggctgaggggctcccaccccacggcagtgtctaggggtgaatgtttgcagctcctgaagccccagcaggcatgtgttagagggtgctctttcagtttagccttgtaggtggcttgtgttagtcagctgttagactccctgccttatcgcaaggacagagggctttctgtatccctaggtttcttgccttgatgtactggagcaatcagatcacacggcggcttggagaaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcgggggtttttttttttttttttggaaatggagtctctctctgttgcccaggctggagtgcaatggcacgatctcggctcacgtcaacctccgcctcccaggttcaagcgatcctcccatctcagcctcccgaagaggtgggattacaggcgcacattgccacacccaact

SEQ ID NO: 311921 - DNA, 1331 bp, Homo sapiens
acgaaaagcgcgcgcggggattccaggagtcgtggtgaccagggaggggagccgggccagcgggcggcaggagactaggggagctgagccatgggcttgggggagagcggggccgggagctcgaaggagaccagaagagccgggggtttgggagagagacaaggagagcggggcggaggcttgggggagaccaggagtaaatcacaaaaatttactttggaaaccgtggcttctggcagaaacagatcagtgtcgggacaaagtacacgggcctggtgtgaaactaagccacaaacccatttaccctgtctgacctgcctccgccaccaggacccagtctcagtgaaatgggaaaggttcccttgtcctcctcgaagggcgtgcgatgaggatgtggctcacttcttcagtgccccgcttctcaagcctctaggggaacatacagacaggcaggctgaggggctcccaccccacggcagtgtctaggggtgaatgtttgcagctcctgaagccccagcaggcatgtgttagagggtgctctttcagtttagccttgtaggtggcttgtgttagtcagctgttagactccctgccttatcgcaaggacagagggctttctgtatccctaggtttcttgccttgatgtactggagcaatcagatcacacggcggcttggagaaacccagggaccatgggcgcctccaggctctataccctggtgctggtcctgcagcctcagcgagttctcctgggcatgaaaaagcgaggcttcggggccggccggtggaatggctttgggggcaaagtgcaagaaggagagaccatcgaggatggggctaggagggagctgcaggaggagagcggtctgacagtggacgccctgcacaaggtgggccagatcgtgtttgagttcgtgggcgagcctgagctcatggacgtgcatgtcttctgcacagacagcatccaggggacccccgtggagagcgacgtgcctcctcttcccccattggtacagaaatgcgcccatgctggttccagctggatcagatccccttcaaggacatgtggcccgacgacagctactggtttccactcctgcttcagaagaagaaattccacgggtacttcaagttccagggtcaggacaccatcctggactacacactccgcgaggtggacacggtctagcgggagcccagggcagcccctgggcaggagacgtggctgctgaacagccgcaaaccatcttcacctgggggcattgagtggcgcagagccgggtttcatctggaattaactggatggaagggaaaataaagctatctagcgg

SEQ ID NO: 311922 - DNA, 1616 bp, Homo sapiens
  misc_feature (1532)..(1532): n is a, c, g, or t
  misc_feature (1559)..(1559): n is a, c, g, or t
atggtggtgcatgcctgtagtcccagctacttgggaggctgaggcaggagaatggcatgaacccaggaagcggaggttgcagtgagccaagatcgcgccattgcactccagcctgggtaacagaacaagactccgtctcaaaaaataaataaataaattccaaatgtaaggtggaaatggcagattataacttcatttcccccatttttaacttagaaaaaacaaagtccttaattttcaagtattagccccccagaagtttcagcagatagctggactcttgaataatgatttcttttgatatgtctgactttgctatttaaagtctcctttcccagccctcagtcttaaaactcagttttattactgacggatttaacagactcttacttgaaaattgtccaattatcagtactgaaaattagatttggaaaatgaaaaaataataaaatcgcatcaagaaaacttattaccttagagattcccaattgatatctgtacccctgatccaagtaaggcctttatgaatgtattttatatttcctaaagaaatagggaatatgccatcagtgtaatcacctctattcacagtcatttaatttgaaaatctaactcatgtctcttgaattagacattccaattgggataggtagagtcatgttaaaacaatagaatagcaactgccatattggtagtttcactgctcaatatgatttctaataagagcagagctttattggaagctaaaactcatttttctccatagatgattctaacagtttaataaaaaagtataattatactttaagtgtcaacagattttgagtctagaagcaaatttcattttccttgtgttatatctaatatccattgacatgggtaagaaaactaattatgtctttttagtatgatgaaatgtgggcccagagtattggaaagaaagcaatagccctattcagtgtccactaggatggatattgcagaaggcatgagtttgtccttttttcccccttaccttaaataacacttcaatagctaactttttccaaaatatccatttaggccatctcttatttcttaaagccaaatatttcgtccccagtcttaactctgagttgcaagatcaggctggttggaagaatctttatatttagaaataggatggtgagtggtttgtttattctcttgtaaaattcctttttcagagacataactgcagggagagtcccaagagaactgaagaactgggattatatcattaaacacatttgtgttgtaggaatttggggagttttcattttgaactgataagatattagacataaacccttgttccagcccacatgtgtcatccctgtgtacaaaagctctctggattcttttttttttttgagacggagtttcgctcttatcgtccaggctggagtgagtgtagtggcttgatctcagctcactgcaacctttgcctcccgggctcaggagaatggcatgaacccaggaagcggaggttgcagtgagccaagatcgcgccnttgcactccagcctgagtaacagaacnaagctccgtctcaaaaaataaataaataaattccaaatgtaaggtggaaatggcaga

SEQ ID NO: 311923 - DNA, 388 bp, Homo sapiens
tgatcgagctcggtaccatcttattaaaattaaggtctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttttaataaggatcccctaggttgaaatgggcacagaaatttcactttccttagctgcattctagtagcttggccaagttatctcgtaattctgttagttcaaatatctttccatcc

SEQ ID NO: 311924 - DNA, 3220 bp, Homo sapiens
ttccagtcagataatggcattgtacagacatgggaaacaaccaatttttttgtttttcagttgttgctatgaatgattttgagcctttttttttaagcttggcaaacatcccagctaatcaaaatagtcatattcctgagaagtaggaaactaaaacttcttttcatataattgttagaaggtttgtttcccaaactaccatagttacaaaggtgaaaagccaaattttaggaacagaatcaaaagaataaaaatctgtgaagagatcctactactcttccttctatgttttggttttggtttctattgtccctatcatttcagcaagtggaacagcagcaagtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgcaaaatgattgagaggcttttggtgcaggcagccgttaacctcctgcttcctttgttacctctggattactttgcagtaaattgcaggtcttttaagagatttaagcttcagttttctcaaaacaaaacaattatcctgtcttatctgaagatgcagggttgtgggcaaaagaggctggttataataatgccctcatattgagtggtctgtaaacggctgcacacttcaggcactgtagttgctgaagatgctttgttaaatgtgaccttgactggctttacaggggtgtagaatgtaatctacacaaggtgactttgcatctatcttgctcttgaggtggatgaaattgagaagctggagtgtgtaagccatgcacataagtattcttcactgtaaattttgttttcatttttaacccaattatggtactttatccaatgcacaactgatctctcagtagatattcatttgaaaatagtgtggccttgatcagtgagaaagggaaggagaaaagtgacttttttgcttatgtagaaatgactcatttgctgagagtttgtctttctgcagcactcttggtataatgttagtgatcggtctcctttttgattggggaaagttaatgtttttgaccctggagttaattcagttgagttatcttatatttttaggaagtatcagaattgctctgatgaataacaaagttgactgttttgatgtccaatctcaggttttagaatatagtggtgtaaagtcccactatttttaattcttaaaacaactttaatttcgtacaccctaaaagtcacatgcataaggcctgttcagagagcagagcctccatctttttgctccttttctactttgtacttcacttgaaaaaatatcaagtgactttacattgtatatttccattgtaaccctgacatttctcaaagataaagcactttttgatcatgaaatacatgaaatctttgtgtgatgtggatcatagtttctcaggctcccttagataattgcttatgaatattgttctaactctgtgtaagaagagtagaaatctttgctaatgttagaaggtttgtattattgatccagaatgcattttgctagtttccaatggatgggagagtaaataatgctgcattcacaatttaataagttactttcccttgagccttaaggtaactttttcttttctgtcaactacagcactgaagttatagtaagtgaatgagattatcagttttcagggttggttttagagtactgtaaatcaattagctgtcttcctaaagagttacaactcccattcagtatactggataatgggtgtgtgggtggggctggggagggcgggagatagtttgtagaaaagaaaaaagaaaaaaaaaaaaacacatttaccttaagaaaatacagacaaaaaagaataaagtatgtgtcatatgctccatcacgcctagcctactctctgaatttctaaaagtcagtaggttgaccaaaaagtctagaaactggctttaagtcagtatgggacgtacttataaagagtccatggttttgcacgtttcggtagacaagtaaatctgagttatttttcaatgacttaccaatatttgaatagtaactaagatcgtcagtgtatctggacttctttttttgaagttctaaaacaattatagtagggatttattattttgggcctccatccagatgtttttccaagatcatttttaaaattcatttgtcttctgtttccagataacatactttccgttctataggaatcttcactgccaatcatagtatctaccagtggctttcttagactattcactccaaagctgggactgatgtcctgccagtagagaatctacagaaataatttgaatgaattaaaaccaaatcttgatagcaggagacagcttcctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatccttcctgctggtgtgcactccttacaatagacttttgcaaatggagttttacagtctatatttaaaaaaaattgtatgtttgtaacaaataaagtatgcagaaaagtgaa

SEQ ID NO: 311925 - DNA, 3166 bp, Homo sapiens
ttccagtcagataatggcattgtacagacatgggaaacaaccaatttttttgtttttcagttgttgctatgaatgattttgagcctttttttttaagcttggcaaacatcccagctaatcaaaatagtcatattcctgagaagtaggaaactaaaacttcttttcatataattgttagaaggtttgtttcccaaactaccatagttacaaaggtgaaaagccaaattttaggaacagaatcaaaagaataaaaatctgtgaagagatcctactactcttccttctatgttttggttttggtttctattgtccctatcatttcagcaagtggaacagcagcaagtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgcaaaatgattgagaggcttttggtgcaggcagccgttaacctcctgcttcctttgttacctctggattactttgcagtaaattgcaggtcttttaagagatttaagcttcagttttctcaaaacaaaacaattatcctgtcttatctgaagatgcagggttgtgggcaaaagaggctggttataataatgccctcatattgagtggtctgtaaacggctgcacacttcaggcactgtagttgctgaagatgctttgttaaatgtgaccttgactggctttacaggggtgtagaatgtaatctacacaaggtgactttgcatctatcttgctcttgaggtggatgaaattgagaagctggagtgtgtaagccatgcacataagtattcttcactgtaaattttgttttcatttttaacccaattatggtactttatccaatgcacaactgatctctcagtagatattcatttgaaaatagtgtggccttgatcagtgagaaagggaaggagaaaagtgacttttttgcttatgtagaaatgactcatttgctgagagtttgtctttctgcagcactcttggtataatgttagtgatcggtctcctttttgattggggaaagttaatgtttttgaccctggagttaattcagttgagttatcttatatttttaggaagtatcagaattgctctgatgaataacaaagttgactgttttgatgtccaatctcaggttttagaatatagtggtgtaaagtcccactatttttaattcttaaaacaactttaatttcgtacaccctaaaatctactttgtacttcacttgaaaaaatatcaagtgactttacattgtatatttccattgtaaccctgacatttctcaaagataaagcactttttgatcatgaaatacatgaaatctttgtgtgatgtggatcatagtttctcaggctcccttagataattgcttatgaatattgttctaactctgtgtaagaagagtagaaatctttgctaatgttagaaggtttgtattattgatccagaatgcattttgctagtttccaatggatgggagagtaaataatgctgcattcacaatttaataagttactttcccttgagccttaaggtaactttttcttttctgtcaactacagcactgaagttatagtaagtgaatgagattatcagttttcagggttggttttagagtactgtaaatcaattagctgtcttcctaaagagttacaactcccattcagtatactggataatgggtgtgtgggtggggctggggagggcgggagatagtttgtagaaaagaaaaaagaaaaaaaaaaaaacacatttaccttaagaaaatacagacaaaaaagaataaagtatgtgtcatatgctccatcacgcctagcctactctctgaatttctaaaagtcagtaggttgaccaaaaagtctagaaactggctttaagtcagtatgggacgtacttataaagagtccatggttttgcacgtttcggtagacaagtaaatctgagttatttttcaatgacttaccaatatttgaatagtaactaagatcgtcagtgtatctggacttctttttttgaagttctaaaacaattatagtagggatttattattttgggcctccatccagatgtttttccaagatcatttttaaaattcatttgtcttctgtttccagataacatactttccgttctataggaatcttcactgccaatcatagtatctaccagtggctttcttagactattcactccaaagctgggactgatgtcctgccagtagagaatctacagaaataatttgaatgaattaaaaccaaatcttgatagcaggagacagcttcctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatccttcctgctggtgtgcactccttacaatagacttttgcaaatggagttttacagtctatatttaaaaaaaattgtatgtttgtaacaaataaagtatgcagaaaagtgaa

SEQ ID NO: 311926 - DNA, 2901 bp, Homo sapiens
atggtggtgcatgcctgtagtcccagctacttgggaggctgaggcaggagaatggcatgaacccaggaagcggaggttgcagtgagccaagatcgcgccattgcactccagcctgggtaacagaacaagactccgtctcaaaaaataaataaataaattccaaatgtaaggtggaaatggcagattataacttcatttcccccatttttaacttagaaaaaacaaagtccttaattttcaagtattagccccccagaagtttcagcagatagctggactcttgaataatgatttcttttgatatgtctgactttgctatttaaagtctcctttcccagccctcagtcttaaaactcagttttattactgacggatttaacagactcttacttgaaaattgtccaattatcagtactgaaaattagatttggaaaatgaaaaaataataaaatcgcatcaagaaaacttattaccttagagattcccaattgatatctgtacccctgatccaagtaaggcctttatgaatgtattttatatttcctaaagaaatagggaatatgccatcagtgtaatcacctctattcacagtcatttaatttgaaaatctaactcatgtctcttgaattagacattccaattgggataggtagagtcatgttaaaacaatagaatagcaactgccatattggtagtttcactgctcaatatgatttctaataagagcagagctttattggaagctaaaactcatttttctccatagatgattctaacagtttaataaaaaagtataattatactttaagtgtcaacagattttgagtctagaagcaaatttcattttccttgtgttatatctaatatccattgacatgggtaagaaaactaattatgtctttttagtatgatgaaatgtgggcccagagtattggaaagaaagcaatagccctattcagtgtccactaggatggatattgcagaaggcatgagtttgtccttttttcccccttaccttaaataacacttcaatagctaactttttccaaaatatccatttaggccatctcttatttcttaaagccaaatatttcgtccccagtcttaactctgagttgcaagatcaggctggttggaagaatctttatatttagaaataggatggtgagtggtttgtttattctcttgtaaaattcctttttcagagacataactgcagggagagtcccaagagaactgaagaactgggattatatcattaaacacatttgtgttgtaggaatttggggagttttcattttgaactgataagatattagacataaacccttgttccagcccacatgtgtcatccctgtgtacaaaagctctctggattcttttttttttttgagacggagtttcgctcttatcgtccaggctggagtgagtgtagtggcttgatctcagctcactgcaacctttgcctcccgggctcaagcgattctcctgcctcagcctcccaagtagctgggattacaagcatgtgccaccatgcccagctaattttttgtatttttagtagagacggggtttcaccatgttggccaggctggtctcgaactcctgacctcaagtgatctgcccgcctcagcttcccaaaatgctggaattacaggcatgagccatcacgcctagcctactctctgaatttctaaaagtcagtaggttgaccaaaaagtctagaaactggctttaagtcagtatgggacgtacttataaagagtccatggttttgcacgtttcggtagacaagtaaatctgagttatttttcaatgacttaccaatatttgaatagtaactaagatcgtcagtgtatctggacttctttttttgaagttctaaaacaattatagtagggatttattattttgggcctccatccagatgtttttccaagatcatttttaaaattcatttgtcttctgtttccagataacatactttccgttctataggaatcttcactgccaatcatagtatctaccagtggctttcttagactattcactccaaagctgggactgatgtcctgccagtagagaatctacagaaataatttgaatgaattaaaaccaaatcttgatagcaggagacagcttcctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatccttcctgctggtgtgcactccttacaatagacttttgcaaatggagttttacagtctatatttaaaaaaaattgtatgtttgtaacaaataaagtatgcagaaaagtgaa

SEQ ID NO: 311927 - DNA, 3440 bp, Homo sapiens
ttccagtcagataatggcattgtacagacatgggaaacaaccaatttttttgtttttcagttgttgctatgaatgattttgagcctttttttttaagcttggcaaacatcccagctaatcaaaatagtcatattcctgagaagtaggaaactaaaacttcttttcatataattgttagaaggtttgtttcccaaactaccatagttacaaaggtgaaaagccaaattttaggaacagaatcaaaagaataaaaatctgtgaagagatcctactactcttccttctatgttttggttttggtttctattgtccctatcatttcagcaagtggaacagcagcaagtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgcaaaatgattgagaggcttttggtgcaggcagccgttaacctcctgcttcctttgttacctctggattactttgcagtaaattgcaggtcttttaagagatttaagcttcagttttctcaaaacaaaacaattatcctgtcttatctgaagatgcagggttgtgggcaaaagaggctggttataataatgccctcatattgagtggtctgtaaacggctgcacacttcaggcactgtagttgctgaagatgctttgttaaatgtgaccttgactggctttacaggggtgtagaatgtaatctacacaaggtgactttgcatctatcttgctcttgaggtggatgaaattgagaagctggagtgtgtaagccatgcacataagtattcttcactgtaaattttgttttcatttttaacccaattatggtactttatccaatgcacaactgatctctcagtagatattcatttgaaaatagtgtggccttgatcagtgagaaagggaaggagaaaagtgacttttttgcttatgtagaaatgactcatttgctgagagtttgtctttctgcagcactcttggtataatgttagtgatcggtctcctttttgattggggaaagttaatgtttttgaccctggagttaattcagttgagttatcttatatttttaggaagtatcagaattgctctgatgaataacaaagttgactgttttgatgtccaatctcaggttttagaatatagtggtgtaaagtcccactatttttaattcttaaaacaactttaatttcgtacaccctaaaagtcacatgcataaggcctgttcagagagcagagcctccatctttttgctccttttctactttgtacttcacttgaaaaaatatcaagtgactttacattgtatatttccattgtaaccctgacatttctcaaagataaagcactttttgatcatgaaatacatgaaatctttgtgtgatgtggatcatagtttctcaggctcccttagataattgcttatgaatattgttctaactctgtgtaagaagagtagaaatctttgctaatgttagaaggtttgtattattgatccagaatgcattttgctagtttccaatggatgggagagtaaataatgctgcattcacaatttaataagttactttcccttgagccttaaggtaactttttcttttctgtcaactacagcactgaagttatagtaagtgaatgagattatcagttttcagggttggttttagagtactgtaaatcaattagctgtcttcctaaagagttacaactcccattcagtatactggataatgggtgtgtgggtggggctggggagggcgggagatagtttgtagaaaagaaaaaagaaaaaaaaaaaaacacatttaccttaagaaaatacagacaaaaaagaataaagtatgtgtcatatgctccatcacgcctagcctactctctgaatttctaaaagtcagtaggttgaccaaaaagtctagaaactggctttaagtcagtatgggacgtacttataaagagtccatggttttgcacgtttcggtagacaagtaaatctgagttatttttcaatgacttaccaatatttgaatagtaactaagatcgtcagtgtatctggacttctttttttgaagttctaaaacaattatagtagggatttattattttgggcctccatccagatgtttttccaagatcatttttaaaattcatttgtcttctgtttccagataacatactttccgttctataggaatcttcactgccaatcatagtatctaccagtggctttcttagactattcactccaaagctgggactgatgtcctgccagtagagaatctacagaaataatttgaatgaattaaaaccaaatcttgatagcaggagacagcttcctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatccttcctgctggtgtgcactccttacaatagacttttgcaaatggagttttacagtctatatttaaaaaaaattgtatgtttgtaacaaataaagtatgcagaaaagtgaaaaaaaaaaaaagagggggcgcttaaaatcccgcagggccagtagcgcacccaggcttggtaagggcctatgagagcgttaaacagacagggcgcctaaacggacgaagcgtctggattggcgaccaccggtgggctgacaccccaacgcgaaactcagatgtaacgctgggagtagtaatcacaaacacacgaacgccacccggcgagcatcacaagcac

SEQ ID NO: 311928 - DNA, 939 bp, Homo sapiens
tatctctaacattataccaagagtgctgcagaaagacaaactctcagcaaatgagtcatttctacataagcaaaaaagtcacttttctccttccctttctcactgatgtcctgccagtagagaatctacagaaataatttgaatgaattaaaaccaaatcttgatagcaggagacagcttcctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatccttcctgctggtgtgcactccttacaatagacttttgcaaatggagttttacagtctatatttaaaaaaaattgtatgtttgtaacaaataaagtatgcagaaaagtgaa

SEQ ID NO: 311929 - DNA, 794 bp, Homo sapiens
tgatcgagctcggtaccatcttattaaaattaaggtctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagaggagcagggctgcttcaaaagagcaatgtgaatacagtcagaagcttcagactggtctgtaaaaatggcgggtcccgtatttaccactaactagcaaaactgacagaaaaactcacagagaaaaaatgtaagaatccttcctgctggtgtgcactccttacaatagacttttgcaaatggagttttacagtctatatttaaaaaaaattgtatgtttgtaacaaataaagtatgcagaaaagtgaa

SEQ ID NO: 311930 - DNA, 3006 bp, Homo sapiens
ttccagtcagataatggcattgtacagacatgggaaacaaccaatttttttgtttttcagttgttgctatgaatgattttgagcctttttttttaagcttggcaaacatcccagctaatcaaaatagtcatattcctgagaagtaggaaactaaaacttcttttcatataattgttagaaggtttgtttcccaaactaccatagttacaaaggtgaaaagccaaattttaggaacagaatcaaaagaataaaaatctgtgaagagatcctactactcttccttctatgttttggttttggtttctattgtccctatcatttcagcaagtggaacagcagcaagtttttcagtgcatatgctgcacaagaacaaaatataaatctgtatggcaccaaaaatcaaagtgaaaaccaaaccaaaaacccaaacaccctatgtaactatcggaggcatatacgtggtataaatgactgtagctgtgatacacacatggctacttgtcacatcactttccataattatttactgcaaaatgattgagaggcttttggtgcaggcagccgttaacctcctgcttcctttgttacctctggattactttgcagtaaattgcaggtcttttaagagatttaagcttcagttttctcaaaacaaaacaattatcctgtcttatctgaagatgcagggttgtgggcaaaagaggctggttataataatgccctcatattgagtggtctgtaaacggctgcacacttcaggcactgtagttgctgaagatgctttgttaaatgtgaccttgactggctttacaggggtgtagaatgtaatctacacaaggtgactttgcatctatcttgctcttgaggtggatgaaattgagaagctggagtgtgtaagccatgcacataagtattcttcactgtaaattttgttttcatttttaacccaattatggtactttatccaatgcacaactgatctctcagtagatattcatttgaaaatagtgtggccttgatcagtgagaaagggaaggagaaaagtgacttttttgcttatgtagaaatgactcatttgctgagagtttgtctttctgcagcactcttggtataatgttagtgatcggtctcctttttgattggggaaagttaatgtttttgaccctggagttaattcagttgagttatcttatatttttaggaagtatcagaattgctctgatgaataacaaagttgactgttttgatgtccaatctcaggttttagaatatagtggtgtaaagtcccactatttttaattcttaaaacaactttaatttcgtacaccctaaaagtcacatgcataaggcctgttcagagagcagagcctccatctttttgctccttttctactttgtacttcacttgaaaaaatatcaagtgactttacattgtatatttccattgtaaccctgacatttctcaaagataaagcactttttgatcatgaaatacatgaaatctttgtgtgatgtggatcatagtttctcaggctcccttagataattgcttatgaatattgttctaactctgtgtaagaagagtagaaatctttgctaatgttagaaggtttgtattattgatccagaatgcattttgctagtttccaatggatgggagagtaaataatgctgcattcacaatttaataagttactttcccttgagccttaaggtaactttttcttttctgtcaactacagcactgaagttatagtaagtgaatgagattatcagttttcagggttggttttagagtactgtaaatcaattagctgtcttcctaaagagttacaactcccattcagtatactggataatgggtgtgtgggtggggctggggagggcgggagatagtttgtagaaaagaaaaaagaaaaaaaaaaaaacacatttaccttaagaaaatacagacaaaaaagaataaagtatgtgtcatatgctccatcacgcctagcctactctctgaatttctaaaagtcagtaggttgaccaaaaagtctagaaactggctttaagtcagtatgggacgtacttataaagagtccatggttttgcacgtttcggtagacaagtaaatctgagttatttttcaatgacttaccaatatttgaatagtaactaagatcgtcagtgtatctggacttctttttttgaagttctaaaacaattatagtagggatttattattttgggcctccatccagatgtttttccaagatcatttttaaaattcatttgtcttctgtttccagataacatactttccgttctataggaatcttcactgccaatcatagtatctaccagtggctttcttagactattcactccaaagctgggactgatgtcctgccagtagagaatctacagaaataatttgaatgaattaaaaccaaatcttgatagcaggagacagcttcctgatctagatgtacaattagagtttaggttggaaattactttaaaatgtgttttttggggatgtcttcaatctctgtgtaaatacccacatgcttatgcattgtaaaccaagtgtgtattcctgtgtatgaatttgtagaactgatttctgcttcaagagaagctgcacctttaattttataaggtcccctccacctgtaaccctataaatgtctgtaaataaaacactaaaatttgtagtgataggatcaatttgggaatatctgctgagagaccaaaaagttcatttttttaagtaccttggttaaagagtaaagattattcctcttattttttaaagaagaatgcactttaacaaacatagagctgcatgggcaattcaaacaaatctgtgaagtgcagtacccattcagaaatcacacttcctgaaaaccgttcaaaagcagagtccagacgggctgttgatctcactgcctgtaggttgaagctcagattctgatcaattttgagagggccagtacatcaagcaggggatctctagag

SEQ ID NO: 311931 - DNA, 607 bp, Homo sapiens
cttcctctgactgtgtcttgatttcctattctgagaggctattgctcagcggtttccgtggcaacagtaaagcgtgggaattacagataaattaaaactgtggaacccctttcctcggctgccgccaaggtgttcggtccttccgaggaagctaaggccgcgttggggtgagaccctcacttcatccgagtcattcttatagaagagcatcagaggaagataaaaaagaatcctcaatgtcaggcccctgagcccaagctaagccatcataaccctgtgacctgcacatatacatccagatggcctgaagcaactgaagaaccataaacgtgaaatagccagttcctgccttaactgatgacattccaccattgtgatttgttcctgctccaccctaactgatcaattgatcttgtgacattccttctcctggacaatgagtctcaggagctcctcaccaagcaccttgttacccccacccctgcccacaagagaaaacgcacgttaactgtaatttttccactacctacccaaatcctataaaactgccccaccccatctccttttgctgactccaggtgattaaaaaactattgctcacacaaag

SEQ ID NO: 311932 - DNA, 750 bp, Homo sapiens
cttcctctgactgtgtcttgatttcctattctgagaggctattgctcagcggtttccgtggcaacagtaaagcgtgggaattacagataaattaaaactgtggaacccctttcctcggctgccgccaaggtgttcggtccttccgaggaagctaaggccgcgttggggtgagaccctcacttcatccggggactccaaccagcccgagcaacacggatcctgagggcgctcctggttaggcatttgccccactgggacgcctcgccagagcactgtatggcaggcccccatggaggatcaacgcagtggctgaacaccgggaaggaacgggcacttggagtctggacatctaaaacttgaatttctagtaaaccagcaccagcctgaagatcacattctcatcgaaaggtggaaagaagaaaaactcgagccagcctggaaggaccctaccttgtgttgctaaccaccaagactgctgttcgtacagcaaaaaaggatggactcgtcacaccagaatcaagaaagtgccaccccctccagagtcatgggccacagtcccagaggaaaaccctgccaaactaaagctacgaaaaatctcttttcatctattctattactcttctttctttcctcgtgctattgctgaccatctagttattaacataaccaagtcaatttcacctcaaactattgcatttaatgcttgccttgttataccctgtggggacttgccaagtcaaagacagctct

SEQ ID NO: 311933 - DNA, 890 bp, Homo sapiens
cttcctctgactgtgtcttgatttcctattctgagaggctattgctcagcggtttccgtggcaacagtaaagcgtgggaattacagataaattaaaactgtggaacccctttcctcggctgccgccaaggtgttcggtccttccgaggaagctaaggccgcgttggggtgagaccctcacttcatccgttttgtctgcagctcgatttcttggttccctgactgggaagcgaggtgaatggcggatggtcaaggcagctccttaggcggcttaaacctgccctgtggaacatccctgcaggggactccaaccagcccgagcaacacggatcctgagggcgctcctggttaggcatttgccccactgggacgcctcgccagagcactgtatggcaggcccccatggaggatcaacgcagtggctgaacaccgggaaggaacgggcacttggagtctggacatctaaaacttgagtcattcttatagaagagcatcagaggaagataaaaaagaatcctcaatgtcaggcccctgagcccaagctaagccatcataaccctgtgacctgcacatatacatccagatggcctgaagcaactgaagaaccataaacgtgaaatagccagttcctgccttaactgatgacattccaccattgtgatttgttcctgctccaccctaactgatcaattgatcttgtgacattccttctcctggacaatgagtctcaggagctcctcaccaagcaccttgttacccccacccctgcccacaagagaaaacgcacgttaactgtaatttttccactacctacccaaatcctataaaactgccccaccccatctccttttgctgactccaggtgattaaaaaactattgctcacacaaag

SEQ ID NO: 311934 - DNA, 874 bp, Homo sapiens
aatctggctctgcaactcagcagagtgcttctcggagaatgttagtctcctcatctgcaacatgggaaggcccctttcttccaaggagtttgtgaatatcacaaaagaatggctatgaaagtctttccttgtaaagggaatcttaccgtgatgtttctatacccagtccatggcccaacaccaggcggcagcacccaatcacggtacaaagaacccgaagcagattcctcaggacggggttctacccaaaccaaatcgagttcctcatccttctcccagggatgactgaactatggaagaaacaaagcactgttaaacagcatacaattcctgtcttcaaaaaagttatctcattaggtagatgagacttataatgaattaaaaggaatgaatacagatttggagatagtggttgttgtgatggaaaatcttaattgcgttttcttccaaaacagagtcattcttatagaagagcatcagaggaagataaaaaagaatcctcaatgtcaggcccctgagcccaagctaagccatcataaccctgtgacctgcacatatacatccagatggcctgaagcaactgaagaaccataaacgtgaaatagccagttcctgccttaactgatgacattccaccattgtgatttgttcctgctccaccctaactgatcaattgatcttgtgacattccttctcctggacaatgagtctcaggagctcctcaccaagcaccttgttacccccacccctgcccacaagagaaaacgcacgttaactgtaatttttccactacctacccaaatcctataaaactgccccaccccatctccttttgctgactccaggtgattaaaaaactattgctcacacaaag

SEQ ID NO: 311935 - DNA, 1033 bp, Homo sapiens
ggccccgacccggccggggagccccgtccctccccggaccgccttggccaatcagctccgctcctccttggccatccggctccgccccttcccggccagccccgccccgtcgtttctctccctgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatggaaagaatatggcaaagctgatgcaagatgggtttattttgatccaaccattgtgtctgtggaaattctgaccgtcgccctggatgggtctctggcattgttcctcatttatgccatagtcaaagaaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattat

SEQ ID NO: 311936 - DNA, 983 bp, Homo sapiens
aaatgcatgctggtactggctggggtttttggattcttggcctgttgtgcgtcgtgaagcctgaagcattggcgctgagtgggagctgggtggcctgatgtgactggctgtgttctgtctgcttgtctgtgctgcctgctgtctcgctgtgctgtgctgtgtgctgctgcccgtgtgtgctctgctgctctgtgtgtcctgctgtgtgcagtgctgtgctgtgtgtgacctgctgtgtggcgctcatctggctctgctacgacgctgctgtgtgcacttctgctgctggaatgtgaaggcccttttgtctacttgtctttagtaggaaacgttgcaaattccgatggcttgattgcttctttatggaaagaatatggcaaagctgatgcaagatgggtttattttgatccaaccattgtgtctgtggaaattctgaccgtcgccctggatgggtctctggcattgttcctcatttatgccatagtcaaagaaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattat

SEQ ID NO: 311937 - DNA, 963 bp, Homo sapiens
ggccccgacccggccggggagccccgtccctccccggaccgccttggccaatcagctccgctcctccttggccatccggctccgccccttcccggccagccccgccccgtcgtttctctccctgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctgggaaagaatatggcaaagctgatgcaagatgggtttattttgatccaaccattgtgtctgtggaaattctgaccgtcgccctggatgggtctctggcattgttcctcatttatgccatagtcaaagaaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattat

SEQ ID NO: 311938 - DNA, 1056 bp, Homo sapiens
aaatgcatgctggtactggctggggtttttggattcttggcctgttgtgcgtcgtgaagcctgaagcattggcgctgagtgggagctgggtggcctgatgtgactggctgtgttctgtctgcttgtctgtgctgcctgctgtctcgctgtgctgtgctgtgtgctgctgcccgtgtgtgctctgctgctctgtgtgtcctgctgtgtgcagtgctgtgctgtgtgtgacctgctgtgtggcgctcatctggctctgctacgacgctgctgtgtgcacttctgctgctggaatgtgaaggcccttttgtctacttgtctttagtaggaaacgttgcaaattccgatggcttgattgcttctttatgcgagtctcgctctgtcccccaggctggagcacagtggcaccatctcggctcactgcaagctccgcctcccagggaaagaatatggcaaagctgatgcaagatgggtttattttgatccaaccattgtgtctgtggaaattctgaccgtcgccctggatgggtctctggcattgttcctcatttatgccatagtcaaagaaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattat

SEQ ID NO: 311939 - DNA, 1014 bp, Homo sapiens
cccccccaccctcccgcgggcccgccgcgagcacgctcttccaaaacttgtcttgatcggctgtatcgcattctggcgttggtgtagctagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatggaaagaatatggcaaagctgatgcaagatgggtttattttgatccaaccattgtgtctgtggaaattctgaccgtcgccctggatgggtctctggcattgttcctcatttatgccatagtcaaagaaaaatattaccgggacagagtggcctggggtgaatagattgctatcctgagatgaatccctaaaacaatttcaagcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattat

SEQ ID NO: 311940 - DNA, 1085 bp, Homo sapiens
ggccccgacccggccggggagccccgtccctccccggaccgccttggccaatcagctccgctcctccttggccatccggctccgccccttcccggccagccccgccccgtcgtttctctccctgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatggaaagaatatggcaaagctgatgcaagatgggtttattttgatccaaccattgtgtctgtggaaattctgaccgtcgccctggatgggtctctggcattgttcctcatttatgccatagtcaaagaaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattatgaaaaaaaaagaaaaaagtgtaatatataaataaaaatagatattatggaaa

SEQ ID NO: 311941 - DNA, 1671 bp, Homo sapiens
ggccccgacccggccggggagccccgtccctccccggaccgccttggccaatcagctccgctcctccttggccatccggctccgccccttcccggccagccccgccccgtcgtttctctccctgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatggaaagaatatggcaaagctgatgcaagatgggtttattttgatccaaccattgtgtctgtggaaattctgaccgtcgccctggatgggtctctggcattgttcctcatttatgccatagtcaaagaaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattataaccaaccagcaaacaaaaaacaaaaaaaaaaaaaaaaaacacaaaaaaaaaacaagaaaacaaacaaaaaaaaaaaaacaaaacaaaaaaacagaagaggggggcgcgcgcggagcgaaggaaaatcctcccccggagggggccgcccaagccgcaggcaccccccagtatttgtgaagaagaggggccccccccaagggggcggtgcaaatattaacacaaccagcagagacgcggccgggcgtttaaaacaaaaaggcggagtgccgagaggagacacaaaccgcgcacgaacaacgaggcctaacaaattgagagggcaaaacaacacctccccacgtcatggggagggggggacaaaacattgagagggagcaaaacacaccactcccagacgtagattttcacacacgctgcccgcagaggaggcaaaaaaaacatacacagtaacagccgcacgacgcgtagatacttgcgggtggaccacaaccaacaaacgaagatacatcacgctacgcagcccacaagcaaagcatgtacgatagcgcacgaggagccaagcatcagtataccagaccacaaaacttaacacaccgcagcgggcgcgtcgacatctaccataagataaggagacatg

SEQ ID NO: 311942 - DNA, 814 bp, Homo sapiens
ggccccgacccggccggggagccccgtccctccccggaccgccttggccaatcagctccgctcctccttggccatccggctccgccccttcccggccagccccgccccgtcgtttctctccctgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatgcgagtctcgctctgtcccccaggctggagcacagtggcaccatctcggctcactgcaagctccgcctcccaggttcacgccattctcctgcctcagcctcccgagtagctgggactacaggcgcccgccaccacgcctagctaatttttttgtatttttagtagagacggggtttcaccatgttagccaggatggtctcgatctcctgacctcgtgatctgcccacctcggcctcccaaagtgctggggttataggcatgagccaccgcgcctggcccatatatctcatttctttgtgactctaaaatcatctccagctaggatctgtgtgggggactcctgtttaccactagtgttaggaaacatctagagaattgagtaggctcattagtacttccc

SEQ ID NO: 311943 - DNA, 824 bp, Homo sapiens
ggccccgacccggccggggagccccgtccctccccggaccgccttggccaatcagctccgctcctccttggccatccggctccgccccttcccggccagccccgccccgtcgtttctctccctgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattat

SEQ ID NO: 311944 - DNA, 1095 bp, Homo sapiens
ggccccgacccggccggggagccccgtccctccccggaccgccttggccaatcagctccgctcctccttggccatccggctccgccccttcccggccagccccgccccgtcgtttctctccctgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatggaaagaatatggcaaagctgatgcaagatgggtttattttgatccaaccattgtgtctgtggaaattctgaccgtcgccctggatgggtctctggcattgttcctcatttatgccatagtcaaagaaaaatattaccgggacagagtggcctggggtgaatagattgctatcctgagatgaatccctaaaacaatttcaagcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattat

SEQ ID NO: 311945 - DNA, 894 bp, Homo sapiens
ggccccgacccggccggggagccccgtccctccccggaccgccttggccaatcagctccgctcctccttggccatccggctccgccccttcccggccagccccgccccgtcgtttctctccctgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatgcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattat

SEQ ID NO: 311946 - DNA, 1088 bp, Homo sapiens
ggccccgacccggccggggagccccgtccctccccggaccgccttggccaatcagctccgctcctccttggccatccggctccgccccttcccggccagccccgccccgtcgtttctctccctgctttcctctgccgcatggtcctgggccgttggcgtcggaagcctgaagcatgggcgctgagtgggagctgggggccgaggctggcggttcgctgctgctgtgcgccgcgctgctggcggcgggctgcgccctgggcctgcgcctgggccgcgggcagggggcggcggaccgcggggcgctcatctggctctgctacgacgcgctggtgcacttcgcgctggaaggcccttttgtctacttgtctttagtaggaaacgttgcaaattccgatggcttgattgcttctttatggaaagaatatggcaaagctgatgcaagatgggtttattttgatccaaccattgtgtctgtggaaattctgaccgtcgccctggatgggtctctggcattgttcctcatttatgccatagtcaaagaaaaatattaccggcatttcctgcagatcaccctgtgcgtgtgcgagctgtatggctgctggatgaccttcctcccagagtggctcaccagaagccccaacctcaacaccagcaactggctgtactgttggctttacctgtttttttttaacggtgtgtgggttctgatcccaggactgctactgtggcagtcatggctagaactcaagaaaatgcatcagaaagaaaccagttcagtgaagaagtttcagtgaactttcaaaaccataaacaccattatctaacttcatgaaccagaatgaatcaaatctttttgtttggccaaaatgtaatacattccagtctacactttgtttttgtattgttgctcctgaacaacctgtttcaaattggttttaaggcgaccagttttcgttgtattgttgttcaattaaatggtgatatagggaaaagagaacaaatttgaatttgtaataataaaatgtttaattatatacattttatggctggcattaattgttccacattagtaaaaccaattatcttag

SEQ ID NO: 311947 - DNA, 659 bp, Homo sapiens
ttttttttttcccgagaggtctttctgtatttcagcactacaggtgtgggcagacagaacagctcatccagaaagaatccaaactgaaaacctaactttcaaatcacacccacatgttaagctggtgcagcagcctccccagatacaaggaaaatgacccttctctgcatggcactcagtggtgtaaagacactcggactcttaagcttatagaagacagaactttctagtgggctgaaaatacttaatgttccattgtttgccctctgattcctcaggtggccactgaaatctcatgcattcgtcggctcaaagtttggaattctacctagtcttgagactactatcttgtatttctttgcagtaatttttttgcattgagatttctttccctctgaattctagcctggtgccttgtaggtttcttgctgccttccctttcccagataatagcatcctacaaaatttggtgttatttctaaacccagagtagatacttcagtcctagtgattatttccctaggctgtcagctcatatggtagccctcaaaagttgaatgctggccaggtgcagtggctcacacctgtaatcccagcactttgggaggccaagggaggtggatcacgaggtcaggagtttgacaccagcctgggcaaca

SEQ ID NO: 311948 - DNA, 2771 bp, Homo sapiens
  misc_feature (198)..(199): n is a, c, g, or t
tttgctcatactttgtgacttgcggtcacagtggcattcagctccacacttggtagaaccacaggcacgacaagcatagaaacatcctaaacaatcttcatcgaggcatcgaggtccatcccaataaaaatcaggagaccctggctatcatagaccttagtcttcgctggtatactcgctgtctgaaccagcggttgnntttttttaagccttcttttttctcttttaccagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaa

SEQ ID NO: 311949 - DNA, 899 bp, Homo sapiens
  misc_feature (891)..(892): n is a, c, g, or t
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcagagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtggaaaatctggcttacctggtccctctgggttccttttggcttacttaccnnggtggaa

SEQ ID NO: 311950 - DNA, 1207 bp, Homo sapiens
cataatttgtgggactaagggcaaaatgaaactgtacggccctcgttcaaaaattaggtgtggggtgcttctaagcacagtcttgtgcaactgcacaggttgcatgtccatgaagccatcctgtgtgtgtgcacatatgtgtatgaatatgtattttatataatacatatatatgcatgtatgtatctgagaagaaatgtttaaaaggctacatacaagcttttccaggtctctactatctgttaactaactagagacataactcacaatatgcagtccccactgagtgttcaccataatttgagattcttggcatgttaacttttcattatggaatattgaataatttcaatattattcatacatttcttgatgttcaaacatacacaaaaatagaataatgaaactctacccatcacccagctgcaacaaatatcaatactttaccgttcttaatacatctaaccccttactttttgtttgtttcttttggtgaagtatttaattgtaattttttttttaagagacaggatctcactctgtcacccaggccagagtacagtggtacgatcacagctccttgtaacctcgaactcctaggctcaagtgatcctcctgcctcagccgcttgaatagctgggactacatgcatacaccaacacacccaactaatttttaaattttttgtagaaatatggtcttgctgtgtttcccaggctggtctcaaactcctggccttgagagattctcctgccttggtcttccaaactgctgggattacaatatccggccctactggaatattttaaagtaaatctcaggtgttacatcattgcacttgtaagtactttaaaatgtatctctagcagataaatctttttaacaaaaccacagcatcattgtcacactcaaaaaattgacaagatttccttaattatcatataatagtctgtattgtttctatctcaaaaatacagttttcttggttgttgaaatctagatccaacattgcatttggttgatgtgtctcctttactctgtaaaatttacccctgcgttttagttcttttcggcttttatttgtcctgtggaatttcctccactcaggatttgactgagagtatccccagagtgtccagttagacctagaagctggatttgatcctggttcatttattttcccccaaaatactccataggtgatgct

SEQ ID NO: 311951 - DNA, 526 bp, Homo sapiens
aaaaaatgctcaacatcactaattatcgggaaatgcaaatcaaaaccacaatgcaataataccaccttactcctgcaagaatggccatattaaaaaaaaaaaaaatagatgttgatgtggatatggtggaaagggaacacttttacactgctggtgggaatgtaaactagtacaaccactatggaaaacagaatagagatgccgtaaagaactgaaagtagatccaccatttgattcagcagtcccctcctgagtagctggattacaggcatgtgccacccacccaactaatttttgtgtttttaataaagacaggggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaa

SEQ ID NO: 311952 - DNA, 2910 bp, Homo sapiens
ctttggtgggtttgttttttagatgtgtaaaaaggctttatttgcaggggagcaggaatttaatcaaaaaggccaaatcccatgtcatcatctgactcttcagactcctccttcttctcatctttcttctcctctgctgcagcaggggcagaaccagcagcaggggctgcagagcctggggcagcagagacggctacagccccaccagcaggtacactggcaagcttgccaataccctgggcaatgacgtcttcaatgttttttccattcagctcactgataaccttgttgagccggtcgtcgtccgcctcgatacccacgctgtccaagatcttcttgatgtccttggcgctgggggaggagttgccccctagggcagccagcaggtaggaggcgacgtagcgcatcgcggcggcgtctgcggcggaggcggcggagaagtctcacgcgtgcgaccctcgtgccgaattcggcacgagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaa

SEQ ID NO: 311953 - DNA, 2605 bp, Homo sapiens
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcagagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaaagtctcactgtgtcgcccaggctggagtgcagtggcacgatctcggctcactgcaacctctgcctcccaggttcaagtgattctcctgcctctgcttcctgagtagctgggattacaggctggtctcaaactcctggccttgagagattctcctgccttggtcttccaaactgctgggattacaatatccggccctactggaatattttaaagtaaatctcaggtgttacatcattgcacttgtaagtactttaaaatgtatctctagcagataaatctttttaacaaaaccacagcatcattgtcacactcaaaaaattgacaagatttccttaattatcatataatagtctgtattgtttctatctcaaaaatacagttttcttggttgttgaaatctagatccaacattgcatttggttgatgtgtctcctttactctgtaaaatttacccctgcgttttagttcttttcggcttttatttgtcctgtggaatttcctccactcaggatttgactgagagtatccccagagtgtccagttagacctagaagctggatttgatcctggttcatttattttcccccaaaatactccataggtgatgct

SEQ ID NO: 311954 - DNA, 2599 bp, Homo sapiens
gccaagttgagtttttaaagtagaaaatttggagaaattaactttattgtgcagtgaatgagaaagaaagaacggttttgaaagaaagtctctgcatttatgtgagactgagatgagtcctataaaggggagtctccccaacccctctgtctcctaaactgcattgggaaactcagattaaatatgttctgtgagcatcactcattcaaatgtctcttccattgtaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaa

SEQ ID NO: 311955 - DNA, 2260 bp, Homo sapiens
cgcatcttgctcccatcagggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaa

SEQ ID NO: 311956 - DNA, 1649 bp, Homo sapiens
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcagagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccatagtaatatattcttagtaggcctaacacacctccattatctgtaaggctgtcactaaacatgggcccaggtg

SEQ ID NO: 311957 - DNA, 2744 bp, Homo sapiens
caggttttcagaaaatatatgcagaataattccatttatataaagttccagagcatgcaaaactaaatcattttgtataaaaaacccaacaaatgtgatgagacaataatgggaaggaagggaatgagaaatattaaattctggatggtggttatctttgagggaggggaatgatgtgattggggaaatggactttcaaaggtaatggtaacttccttaagctggatggtaggtccactagtgtttgctgcatagttataccttttatcttaaatacattttgtatctattgtaacaaccactttaaagacaaccgtgctgtaaggcagtagctaaaaacagaaaatagtccatcgggaagggtaagatggctttctgctgagcacagggctagaagtgacagcccagtgggccttccaactatatgccagggtgttagatgagtagagaggagaccacccaggaagtctggacaaggggtctggcatgagctctggagaagatatatttgaggaacatggggtatgctagtttgttgtcctgaattgctgtagagaagataatttaaattgcatcttagaagacgaccctgagggtgaatttcaacttagggcaattgttttagtttgtttcttattggtttaaatggatacttgaagctggataatttataaggaaaagagatttatatgacttacagttctgcaggctgtacaagaaacatggcaccagcatctgcttcttccccggctgcttccactcatggtggaaggtgaaggggagccggatgtgcagagatcatatggcaagagaggaagcaagagagcgagggagaaggtgccaggctctttttaaataaccggctcttgagggaactaatagattgagaactccttgcttctcctccccagcacaccccacccccagggacggcattaatgtattcatgaggggtcttcccccatgacccaaacactctcccatcaggccccacctccaacactgggatcaaatttcaacatgagattttgggggacaaacatgcaaactatagcagcaaccagctaccattctaaaactgccatatgattttaggatttttaaaaagggccaaatttaggttaagcaaaaagtgaaaatacagtaagagaaaatagttttataaaggctttaaaaagtgttcataaagagcagttcatagatttttcacgtaacgttcatcaatagatgctaaaactattggatgaaaagctattgtggaataggatcttctacaaggatttaaatataatcctacagaagaggtatcaattatacaggggaaaatgtacctttacaatggtcaccacaataaccaagtgattcaatttagcatcacccaaggtggaacaccctaacattatgcccctcctgatgtgacttaagaattttacctatttagttttcttgcacaaagtgttaaactggaatttaatcatgaggaaattattagacaaatcctgaatgtagtcattctataagatgattgacttgggcttctcaaaaagtcagtgtcatgaaaaaaaaaaaaaggggagagacttgtaagatacaatgaccaaatgcaatgtttgaatctttattgtattctggatatttaaaaagacaaaagctggacgcagtagctaatgcctgttatcccagcatttttgggaggtcaaaaggggaggatggcttgagcataggattttgagactagcctgggcaacacagtgagttctcatctctacaaaaaatcagaaaattagctgggcatggtagtgtgcatctgtggtcccagctacttgggggggtgaggtgggaggatcacttgagcctaggaggtcaaggccgcagtgagccatgatcatgttactgcattccagcctgggtgacagagtgagatcatatctaaataataataataataaaagaaagcaacaacccagcaaacagctataaagatatcttcgggacaattgagaacatttgaatatagactgcatattagataacaatgccaaataactgttttctcaggtgtgataatagtatatgtagaaaatgtctttttgttttgttttattttgttttgttgtttgtttgttttgagacagagtctcactgtgtcgcccaggctggagtgcagtggcacgatctcggctcactgcaacctctgcctcccaggttcaagtgattctcctgcctctgcttcctgagtagctgggattacaggctggtctcaaactcctggccttgagagattctcctgccttggtcttccaaactgctgggattacaatatccggccctactggaatattttaaagtaaatctcaggtgttacatcattgcacttgtaagtactttaaaatgtatctctagcagataaatctttttaacaaaaccacagcatcattgtcacactcaaaaaattgacaagatttccttaattatcatataatagtctgtattgtttctatctcaaaaatacagttttcttggttgttgaaatctagatccaacattgcatttggttgatgtgtctcctttactctgtaaaatttacccctgcgttttagttcttttcggcttttatttgtcctgtggaatttcctccactcaggatttgactgagagtatccccagagtgtccagttagacctagaagctggatttgatcctggttcatttattttcccccaaaatactccataggtgatgct

SEQ ID NO: 311958 - DNA, 2141 bp, Homo sapiens
caggttttcagaaaatatatgcagaataattccatttatataaagttccagagcatgcaaaactaaatcattttgtataaaaaacccaacaaatgtgatgagacaataatgggaaggaagggaatgagaaatattaaattctggatggtggttatctttgagggaggggaatgatgtgattggggaaatggactttcaaaggtaatggtaacttccttaagctggatggtaggtccactagtgtttgctgcatagttataccttttatcttaaatacattttgtatctattgtaacaaccactttaaagacaaccgtgctgtaaggcagtagctaaaaacagaaaatagtccatcgggaagggtaagatggctttctgctgagcacagggctagaagtgacagcccagtgggccttccaactatatgccagggtgttagatgagtagagaggagaccacccaggaagtctggacaaggggtctggcatgagctctggagaagatatatttgaggaacatggggtatgctagtttgttgtcctgaattgctgtagagaagataatttaaattgcatcttagaagacgaccctgagggtgaatttcaacttagggcaattgttttagtttgtttcttattggtttaaatggatacttgaagctggataatttataaggaaaagagatttatatgacttacagttctgcaggctgtacaagaaacatggcaccagcatctgcttcttccccggctgcttccactcatggtggaaggtgaaggggagccggatgtgcagagatcatatggcaagagaggaagcaagagagcgagggagaaggtgccaggctctttttaaataaccggctcttgagggaactaatagattgagaactccttgcttctcctccccagcacaccccacccccagggacggcattaatgtattcatgaggggtcttcccccatgacccaaacactctcccatcaggccccacctccaacactgggatcaaatttcaacatgagattttgggggacaaacatgcaaactatagcagcaaccagctaccattctaaaactgccatatgattttaggatttttaaaaagggccaaatttaggttaagcaaaaagtgaaaatacagtaagagaaaatagttttataaaggctttaaaaagtgttcataaagagcagttcatagatttttcacgtaacgttcatcaatagatgctaaaactattggatgaaaagctattgtggaataggatcttctacaaggatttaaatataatcctacagaagaggtatcaattatacaggggaaaatgtacctttacaatggtcaccacaataaccaagtgattcaatttagcatcacccaaggtggaacaccctaacattatgcccctcctgatgtgacttaagaattttacctatttagttttcttgcacaaagtgttaaactggaatttaatcatgaggaaattattagacaaatcctgaatgtagtcattctataagatgattgacttgggcttctcaaaaagtcagtgtcatgaaaaaaaaaaaaaggggagagacttgtaagatacaatgaccaaatgcaatgtttgaatctttattgtattctggatatttaaaaagacaaaagctggtctcaaactcctggccttgagagattctcctgccttggtcttccaaactgctgggattacaatatccggccctactggaatattttaaagtaaatctcaggtgttacatcattgcacttgtaagtactttaaaatgtatctctagcagataaatctttttaacaaaaccacagcatcattgtcacactcaaaaaattgacaagatttccttaattatcatataatagtctgtattgtttctatctcaaaaatacagttttcttggttgttgaaatctagatccaacattgcatttggttgatgtgtctcctttactctgtaaaatttacccctgcgttttagttcttttcggcttttatttgtcctgtggaatttcctccactcaggatttgactgagagtatccccagagtgtccagttagacctagaagctggatttgatcctggttcatttattttcccccaaaatactccataggtgatgct

SEQ ID NO: 311959 - DNA, 2802 bp, Homo sapiens
caggttttcagaaaatatatgcagaataattccatttatataaagttccagagcatgcaaaactaaatcattttgtataaaaaacccaacaaatgtgatgagacaataatgggaaggaagggaatgagaaatattaaattctggatggtggttatctttgagggaggggaatgatgtgattggggaaatggactttcaaaggtaatggtaacttccttaagctggatggtaggtccactagtgtttgctgcatagttataccttttatcttaaatacattttgtatctattgtaacaaccactttaaagacaaccgtgctgtaaggcagtagctaaaaacagaaaatagtccatcgggaagggtaagatggctttctgctgagcacagggctagaagtgacagcccagtgggccttccaactatatgccagggtgttagatgagtagagaggagaccacccaggaagtctggacaaggggtctggcatgagctctggagaagatatatttgaggaacatggggtatgctagtttgttgtcctgaattgctgtagagaagataatttaaattgcatcttagaagacgaccctgagggtgaatttcaacttagggcaattgttttagtttgtttcttattggtttaaatggatacttgaagctggataatttataaggaaaagagatttatatgacttacagttctgcaggctgtacaagaaacatggcaccagcatctgcttcttccccggctgcttccactcatggtggaaggtgaaggggagccggatgtgcagagatcatatggcaagagaggaagcaagagagcgagggagaaggtgccaggctctttttaaataaccggctcttgagggaactaatagattgagaactccttgcttctcctccccagcacaccccacccccagggacggcattaatgtattcatgaggggtcttcccccatgacccaaacactctcccatcaggccccacctccaacactgggatcaaatttcaacatgagattttgggggacaaacatgcaaactatagcagcaaccagctaccattctaaaactgccatatgattttaggatttttaaaaagggccaaatttaggttaagcaaaaagtgaaaatacagtaagagaaaatagttttataaaggctttaaaaagtgttcataaagagcagttcatagatttttcacgtaacgttcatcaatagatgctaaaactattggatgaaaagctattgtggaataggatcttctacaaggatttaaatataatcctacagaagaggtatcaattatacaggggaaaatgtacctttacaatggtcaccacaataaccaagtgattcaatttagcatcacccaaggtggaacaccctaacattatgcccctcctgatgtgacttaagaattttacctatttagttttcttgcacaaagtgttaaactggaatttaatcatgaggaaattattagacaaatcctgaatgtagtcattctataagatgattgacttgggcttctcaaaaagtcagtgtcatgaaaaaaaaaaaaaggggagagacttgtaagatacaatgaccaaatgcaatgtttgaatctttattgtattctggatatttaaaaagacaaaagctggacgcagtagctaatgcctgttatcccagcatttttgggaggtcaaaaggggaggatggcttgagcataggattttgagactagcctgggcaacacagtgagttctcatctctacaaaaaatcagaaaattagctgggcatggtagtgtgcatctgtggtcccagctacttgggggggtgaggtgggaggatcacttgagcctaggaggtcaaggccgcagtgagccatgatcatgttactgcattccagcctgggtgacagagtgagatcatatctaaataataataataataaaagaaagcaacaacccagcaaacagctataaagatatcttcgggacaattgagaacatttgaatatagactgcatattagataacaatgccaaataactgttttctcaggtgtgataatagtatatgtagaaaatgtctttttgttttgttttattttgttttgttgtttgtttgttttgagacagagtctcactgtgtcgcccaggctggagtgcagtggcacgatctcggctcactgcaacctctgcctcccaggttcaagtgattctcctgcctctgcttcctgagtagctgggattacaggtatctgccaccactccaggttaattttttctatttttagtagagacggaatttcaccatgttgacccagctggttttgaactcctgacctcaggtgattcacttgccttggcctcccaaagtgttgagattacaggcatgagtcactgcacccagccaaaaatgtttttttaggcaatgcatgcacaaacatttagaggccaagtgtgtcatgatgtctgcaactttcaatgttcagcaaaaatcaacatggagagagaaagagggcacacatgtggcaaaatattagccattgtacaattggtaaatctagatgacagtacacaggtgtttgttgtattattctttgaacttttctgtagatttggaaatgttctgcgtagagagaaatctttttttaaaaaaacaatatctggttttgattaatgaggctatattcaaaagaaacactaaatgatgtggccagttagtgagaatgtagccttatctttactgacctcattttaatattcctactctggctgggcatggtggctcacgcctataatc

SEQ ID NO: 311960 - DNA, 1984 bp, Homo sapiens
  misc_feature (1954)..(1954): n is a, c, g, or t
  misc_feature (1970)..(1971): n is a, c, g, or t
caggttttcagaaaatatatgcagaataattccatttatataaagttccagagcatgcaaaactaaatcattttgtataaaaaacccaacaaatgtgatgagacaataatgggaaggaagggaatgagaaatattaaattctggatggtggttatctttgagggaggggaatgatgtgattggggaaatggactttcaaaggtaatggtaacttccttaagctggatggtaggtccactagtgtttgctgcatagttataccttttatcttaaatacattttgtatctattgtaacaaccactttaaagacaaccgtgctgtaaggcagtagctaaaaacagaaaatagtccatcgggaagggtaagatggctttctgctgagcacagggctagaagtgacagcccagtgggccttccaactatatgccagggtgttagatgagtagagaggagaccacccaggaagtctggacaaggggtctggcatgagctctggagaagatatatttgaggaacatggggtatgctagtttgttgtcctgaattgctgtagagaagataatttaaattgcatcttagaagacgaccctgagggtgaatttcaacttagggcaattgttttagtttgtttcttattggtttaaatggatacttgaagctggataatttataaggaaaagagatttatatgacttacagttctgcaggctgtacaagaaacatggcaccagcatctgcttcttccccggctgcttccactcatggtggaaggtgaaggggagccggatgtgcagagatcatatggcaagagaggaagcaagagagcgagggagaaggtgccaggctctttttaaataaccggctcttgagggaactaatagattgagaactccttgcttctcctccccagcacaccccacccccagggacggcattaatgtattcatgaggggtcttcccccatgacccaaacactctcccatcaggccccacctccaacactgggatcaaatttcaacatgagattttgggggacaaacatgcaaactatagcagcaaccagctaccattctaaaactgccatatgattttaggatttttaaaaagggccaaatttaggttaagcaaaaagtgaaaatacagtaagagaaaatagttttataaaggctttaaaaagtgttcataaagagcagttcatagatttttcacgtaacgttcatcaatagatgctaaaactattggatgaaaagctattgtggaataggatcttctacaaggatttaaatataatcctacagaagaggtatcaattatacaggggaaaatgtacctttacaatggtcaccacaataaccaagtgattcaatttagcatcacccaaggtggaacaccctaacattatgcccctcctgatgtgacttaagaattttacctatttagttttcttgcacaaagtgttaaactggaatttaatcatgaggaaattattagacaaatcctgaatgtagtcattctataagatgattgacttgggcttctcaaaaagtcagtgtcatgaaaaaaaaaaaaaggggagagacttgtaagatacaatgaccaaatgcaatgtttgaatctttattgtattctggatatttaaaaagacaaaagctggacgcagtagctaatgcctgttatcccagcatttttgggaggtcaaaaggggaggattgccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttanaagccagctggatagnnattggtactcatt

SEQ ID NO: 311961 - DNA, 1476 bp, Homo sapiens
caggttttcagaaaatatatgcagaataattccatttatataaagttccagagcatgcaaaactaaatcattttgtataaaaaacccaacaaatgtgatgagacaataatgggaaggaagggaatgagaaatattaaattctggatggtggttatctttgagggaggggaatgatgtgattggggaaatggactttcaaaggtaatggtaacttccttaagctggatggtaggtccactagtgtttgctgcatagttataccttttatcttaaatacattttgtatctattgtaacaaccactttaaagacaaccgtgctgtaaggcagtagctaaaaacagaaaatagtccatcgggaagggtaagatggctttctgctgagcacagggctagaagtgacagcccagtgggccttccaactatatgccagggtgttagatgagtagagaggagaccacccaggaagtctggacaaggggtctggcatgagctctggagaagatatatttgaggaacatggggtatgctagtttgttgtcctgaattgctgtagagaagataatttaaattgcatcttagaagacgaccctgagggtgaatttcaacttagggcaattgttttagtttgtttcttattggtttaaatggatacttgaagctggataatttataaggaaaagagatttatatgacttacagttctgcaggctgtacaagaaacatggcaccagcatctgcttcttccccggctgcttccactcatggtggaaggtgaaggggagccggatgtgcagagatcatatggcaagagaggaagcaagagagcgagggagaaggtgccaggctctttttaaataaccggctcttgagggaactaatagattgagaactccttgcttctcctccccagcacaccccacccccagggacggcattaatgtattcatgaggggtcttcccccatgacccaaacactctcccatcaggccccacctccaacactgggatcaaatttcaacatgagattttgggggacaaacatgcaaactatagcagcaaccagctaccattctaaaactgccatatgattttaggatttttaaaaagggccaaatttaggttaagcaaaaagtgaaaatacagtaagagaaaatagttttataaaggctttaaaaagtgttcataaagagcagttcatagatttttcacgtaacgttcatcaatagatgctaaaactattggatgaaaagctattgtggaataggatcttctacaaggatttaaatataatcctacagaagaggtatcaattatacaggggaaaatgtacctttacaatggtcaccacaataaccaagtgattcaatttagcatcacccaaggtggaacaccctaacattatgcccctcctgatggacgcagatcgccatcttctcccatcagccatcccaaactagggatcctctagatcgcct

SEQ ID NO: 311962 - DNA, 1186 bp, Homo sapiens
ccatgttgatcgttaatttacacagaggattcagctattcggcggtacagatttgaacctaggcagtcagactccacagattttgctaataaatagacattgttttgtggtgtaagatgttttggtcaaataacttttttgggctttagaaggctggatatttatgtaaggagcataacaaaggtaaatctattttggtctctttagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaa

SEQ ID NO: 311963 - DNA, 1262 bp, Homo sapiens
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcagagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaaggtgagtatcattatgcattgaacatattttgatctgaagttttatttcagacttatttattgttcttaatacttgtagagtattgtacacccttatttgagcagagtttcagaagcagaaagcttgaaatctataaacaaataattttagatgtgtcgagaaatctttgactatgtgcacatgctacactgtaaacataaagcactttgggggta

SEQ ID NO: 311964 - DNA, 733 bp, Homo sapiens
gccaagttgagtttttaaagtagaaaatttggagaaattaactttattgtgcagtgaatgagaaagaaagaacggttttgaaagaaagtctctgcatttatgtgagactgagatgagtcctataaaggggagtctccccaacccctctgtctcctaaactgcattgggaaactcagattaaatatgttctgtgagcatcactcattcaaatgtctcttccattgtaggatacgggaagaagaaatggctggtgatctttcagcaggtttcttcatggaggaacttaatacataccgtcagaagcagggagtagtacttaaatatcaagaactgcctaattcaggacctccacatgataggaggtaggttgctataaaaaatgatatggcagccataaaaaatgatgagttcatgtcctttgtagggacatggatgaagctggaaaccattattctcagcaaactatcgcaaggacaaaaaaaccaaacaccgcatgttctcactcataggtgagaactgagcaatgagaacacatggacacaggaaggggaacatcacacaccagggactgttgtggggtggggggaggggggagggatagcattaggagatatacctaatgctaaatgacgagttaatgggtgcagcacaccaacatggcacatgtatacatatgtaacctgcacgttgtgcacatgtaccctaaaacttaaagtataataataataaaatt

SEQ ID NO: 311965 - DNA, 764 bp, Homo sapiens
tttaattgtaattttttttttaagagacaggatctcactctgtcacccaggccagagtacagtggtacgatcacagctccttgtaacctcgaactcctaggctcaagtgatcctcctgcctcagccgcttgaatagctgggactacatgcatacaccaacacacccaactaatttttaaattttttgtagaaatatggtcttgctgtgtttcccaggctggtctcaaactcctggccttgagagattctcctgccttggtcttccaaactgctgggattacaatatccggccctactggaatattttaaagtaaatctcaggtgttacatcattgcacttgtaagtactttaaaatgtatctctagcagataaatctttttaacaaaaccacagcatcattgtcacactcaaaaaattgacaagatttccttaattatcatataatagtctgtattgtttctatctcaaaaatacagttttcttggttgttgaaatctagatccaacattgcatttggttgatgtgtctcctttactctgtaaaatttacccctgcgttttagttcttttcggcttttatttgtcctgtggaatttcctccactcaggatttgactgagagtatccccagagtgtccagttagacctagaagctggatttgatcctggttcatttattttcccccaaaatactccataggtgatgctatacactttctcttacatcatttcaggaggaacatgatgtctgattgttccactttc

SEQ ID NO: 311966 - DNA, 2681 bp, Homo sapiens
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcagagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaa

SEQ ID NO: 311967 - DNA, 2595 bp, Homo sapiens
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaa

SEQ ID NO: 311968 - DNA, 3013 bp, Homo sapiens
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcagagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaaggtcaaagactaagtgccttttcatccaaatggaattctgtgataaagggaccttggaacaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggccaaacggccatgcccggctaatctttatatttagtgaagatggttagcctgaaaccttgaaacttccccactgaaatacacaaactaggccgggcgtagggctcacacctgtaatctcagcacttcggggagggccaggtgggtggaaccaccaaaggtcaggagtacaaaaccagcaaaaccagacagctcactgcgctctaaccaatgtcacctcagtaccgatgtgactatcggccacagacggggggacaggacatcccatctgcctggcgagggtcctgacaaacgacggccacaggggaacccgacatcgaggcgggcaccaggtagcgtgcccgatgccggaaccatccaagggggcgcgaacactggtgtgacgaccacgcgggaggcctacccgacagcgaaactgggaccccggcaacggacccctaatcaaaacacccgaccacactactgcacggccaccagggatcccgattcggcctaccaccccaccgatagcccacagaagcccgaaaccaagaccgcggacatcagccagacgagccctgatcaaaactcgcagcgctgaacacccacatcgcgcagcgcgcccaccacgacccacctattcacgatcagacaatcctcaacccgataccagacaccagctcacacacggaacaacc

SEQ ID NO: 311969 - DNA, 2622 bp, Homo sapiens
agcagacgagggcttgtgcgagagggggccgggcggctgcagggaaggcggagtccaaggggaaaacgaaactgagaaccagctctcccgaagccgcgggtctccggccggcggcggcggcggcggcggcggcggcgcagagtttctggagcaaattcagtttgccttcctggatttgtaaattgtaatgacctcaaaactttagcagttcttccatctgactcaggtttgcttctctggcggtcttcagaatcaacatccacacttccgtgattatctgcgtgcattttggacaaagcttccaaccaggatacgggaagaagaaatggctggtgatctttcagcaggtttcttcatggaggaacttaatacataccgtcagaagcagggagtagtacttaaatatcaagaactgcctaattcaggacctccacatgataggaggtttacatttcaagttataatagatggaagagaatttccagaaggtgaaggtagatcaaagaaggaagcaaaaaatgccgcagccaaattagctgttgagatacttaataaggaaaagaaggcagttagtcctttattattgacaacaacgaattcttcagaaggattatccatggggaattacataggccttatcaatagaattgcccagaagaaaagactaactgtaaattatgaacagtgtgcatcgggggtgcatgggccagaaggatttcattataaatgcaaaatgggacagaaagaatatagtattggtacaggttctactaaacaggaagcaaaacaattggccgctaaacttgcatatcttcagatattatcagaagaaacctcagtgaaatctgactacctgtcctctggttcttttgctactacgtgtgagtcccaaagcaactctttagtgaccagcacactcgcttctgaatcatcatctgaaggtgacttctcagcagatacatcagagataaattctaacagtgacagtttaaacagttcttcgttgcttatgaatggtctcagaaataatcaaaggaaggcaaaaagatctttggcacccagatttgaccttcctgacatgaaagaaacaaagtatactgtggacaagaggtttggcatggattttaaagaaatagaattaattggctcaggtggatttggccaagttttcaaagcaaaacacagaattgacggaaagacttacgttattaaacgtgttaaatataataacgagaaggcggagcgtgaagtaaaagcattggcaaaacttgatcatgtaaatattgttcactacaatggctgttgggatggatttgattatgatcctgagaccagtgatgattctcttgagagcagtgattatgatcctgagaacagcaaaaatagttcaagaatggattgaaaaaagaagaggcgagaaactagacaaagttttggctttggaactctttgaacaaataacaaaaggggtggattatatacattcaaaaaaattaattcatagagatcttaagccaagtaatatattcttagtagatacaaaacaagtaaagattggagactttggacttgtaacatctctgaaaaatgatggaaagcgaacaaggagtaagggaactttgcgatacatgagcccagaacagatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaa

SEQ ID NO: 311970 - DNA, 1050 bp, Homo sapiens
tgtgcgcccccgttttcctttttcccttctcatctcgtctcccataccctccctctctctacaacttaaaaatttcttcgcaagactatggaaaggaagtggacctctacgctttggggctaattcttgctgaacttcttcatgtatgtgacactgcttttgaaacatcaaagtttttcacagacctacgggatggcatcatctcagatatatttgataaaaaagaaaaaactcttctacagaaattactctcaaagaaacctgaggatcgacctaacacatctgaaatactaaggaccttgactgtgtggaagaaaagcccagagaaaaatgaacgacacacatgttagagcccttctgaaaaagtatcctgcttctgatatgcagttttccttaaattatctaaaatctgctagggaatatcaatagatatttaccttttattttaatgtttcctttaattttttactatttttactaatctttctgcagaaacagaaaggttttcttctttttgcttcaaaaacattcttacattttactttttcctggctcatctctttattcttttttttttttttaaagacagagtctcgctctgttgcccaggctggagtgcaatgacacagtcttggctcactgcaacttctgcctcttgggttcaagtgattctcctgcctcagcctcctgagtagctggattacaggcatgtgccacccacccaactaatttttgtgtttttaataaagacagggtttcaccatgttggccaggctggtctcaaactcctgacctcaagtaatccacctgcctcggcctcccaaagtgctgggattacagggatgagccaccgcgcccagcctcatctctttgttctaaagatggaaaaaccacccccaaattttctttttatactattaatgaatcaatcaattcatatctatttattaaatttctaccgcttttaggccaaaaaaatgtaagatcgttctctgcctcacatagcttacaagccagctggagaaatatggtactcattaaaaaaaaaaa

SEQ ID NO: 311971 - DNA, 4603 bp, Homo sapiens
tggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagtgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtg

SEQ ID NO: 311972 - DNA, 1763 bp, Homo sapiens
tggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaacctggaggagcgagataaggtcggcagtggcaggcggcagtctgcagggatctggaagtctgcagcgtgtcgagggagaggaactgaaccaaaggcggaagctgccaagatgcagacttctgctctgtacagaaaagcatttttccctgtctttttagttaaataattaatttttaattacaagttgtaagcagggtcaccccatgaagcaacttgtgtgaattacaaaaaggagccctctgggctgatatggccctgagctaggcttcaagcctggccaatggagcgaatctcagcccctgtccctgcttggccagtgctcttgtgtgggtcccagcctataccccatggagtattttctcctggtaagaatttggaacgttataaataaataaaaccacgacccccattgatcacctgcccacatgaatcccaggaggagcatttaccccacagccacagctctgcagagttggtgactccttgatgcagtcagtcacagggatccaaatgtggcgttggggagaggtaggaatgggctcctgcggctcccctacagccagcaacacttacctgtggtcagcacacatccaccctccctctctcctgccgcctgagctcctcccttggctaagtcctccttatctatctgctttccttgtgtctcagtagaggctactgacccaactttgcttggagctgaagctccagagacagggaggggtttggggagatccagttagactctcctgctcagaccctctgctccaaactaagactgatgttggccttccagtgtgattctgaaagacatttaatgttttttttggggggggaaggaatgcaaaggtgcagaatccctgaataccacaaatgtacttttcatttctatttctatagatttgcctattctggtggtaaagtaaatgaaatcataaatat

SEQ ID NO: 311973 - DNA, 569 bp, Homo sapiens
ggagctgctggttactgacactaggcacaggggtggagccagggcaagggagtgagaccctgagctccaagcaggtttgtctgtatcccctaccctgggtggtgggggcgctggggctgtggttgatggactgtgttcagggcaggcagcagaaacggcatgcattcccagtctagtgttgggaatgggagctgagcgtgaatgttttcagacacatccaccctccctctctcctgccgcctgagctcctcccttggctaagtcctccttatctatctgctttccttgtgtctcagtagaggctactgacccaactttgcttggagctgaagctccagagacagggaggggtttggggagatccagttagactctcctgctcagaccctctgctccaaactaagactgatgttggccttccagtgtgattctgaaagacatttaatgttttttttggggggggaaggaatgcaaaggtgcagaatccctgaataccacaaatgtacttttcatttctatttctatagatttgcctattctggtggtaaagtaaatgaaatcataaatat

SEQ ID NO: 311974 - DNA, 3017 bp, Homo sapiens
gtggcgatctcgaggatcccctccataatgtgtgcccaggaaggcatacagctccacttctacataggtgcgcacgctgcgttctgacaggaactgcccagagatcaccgtaatggaaagggtggtggccaccaccacgtcgatgcggtccactgagaaggggttgaactgcttgtccggccggcgcatgaactcatgcttgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtgaaaaaaccaaacagggaacaaagacaaaagacacaacagaagcaaaaaagaaacaacagggggggggggcaagaaataagc

SEQ ID NO: 311975 - DNA, 4330 bp, Homo sapiens
tggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagtgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagagcaaatctccaaaatgatggagctggccagagagaaacaggcggcagagctgaaggccctgaaggagacgtcggagaagtacgactgcctccctcccacacctgcttcgcctcccagcaagggctcagccgcacaaaacagctccttcatgcctgtctctctgcagcgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtgaaaaaaccaaacagggaacaaagacaaaagacacaacagaagcaaaaaagaaacaacagggggggggggcaagaaataagc

SEQ ID NO: 311976 - DNA, 1087 bp, Homo sapiens
cgaaacgtccccgggccagtacggatgtgcggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtgaaaaaaccaaacagggaacaaagacaaaagacacaacagaagcaaaaaagaaacaacagggggggggggcaagaaataagc

SEQ ID NO: 311977 - DNA, 4010 bp, Homo sapiens
tggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagtgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgcctgcctgacaaggtcagcatcatttgctctcctgaatttatgaggtttatttatttttctctttcctactcctattaaagaacctcgtcccagtg

SEQ ID NO: 311978 - DNA, 3410 bp, Homo sapiens
tggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagtgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagacagaaagagagagagagagagagagagagagagagagagagagc

SEQ ID NO: 311979 - DNA, 1651 bp, Homo sapiens
tggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaacctggaggagcgagataaggtcggcagtggcaggcggcagtctgcagggatctggaagtctgcagcgtgtcgagggagaggaactgaaccaaaggcggaagctgccaagatgcagacttctgctctgtacagaaaagcatttttccctgtctttttagttaaataattaatttttaattacaagttgtaagcagggtcaccccatgaagcaacttgtgtgaattacaaaaaggagccctctgggctgatatggccctgagctaggcttcaagcctggccaatggagcgaatctcagcccctgtccctgcttggccagtgctcttgtgtgggtcccagcctataccccatggagtattttctcctggtaagaatttggaacgttataaataaataaaaccacgacccccattgatcacctgcccacatgaatcccaggaggagcatttaccccacagccacagctctgcagagttggtgactccttgatgcagtcagtcacagggatccaaatgtggcgttggggagaggtaggaatgggctcctgcggctcccctacagccagcaacacttacctgtggtcagcacacatccaccctccctctctcctgccgcctgagctcctcccttggctaagtcctccttatctatctgctttccttgtgtctcagtagaggctactgacccaactttgcttggagctgaagctccagagacagggaggggaaggaatgcaaaggtgcagaatccctgaataccacaaatgtacttttcatttctatttctatagatttgcctattctggtggtaaagtaaatgaaatcataaatat

SEQ ID NO: 311980 - DNA, 493 bp, Homo sapiens
tgtccttgaagttcttctgtctgccttgagcccgccttctgaccaggtccccttgaccagggctggccgagtttgtggttcttagctctgagaaggtgagggcaggggcaataaggttactatgcccctagaatgacgccatcaatcctgaggacttcccagaacctgtctacaagagtttcctcatgagcctctgtcctcggccagaaatagatgagatcttcacttcttagtgagtttcttgggttgtgctggtcatgggaaaagggtggtggctaacaatcccctcctcccacctgccatgccgggagtcaggaggcttcactggacaagggggttgtctaagcctccaggcccaagggatatggacctgtgctcttctctctggcttgaagccatgctaaggccaaaccctacatgacgaaggagcacctgaccaaattcatcaaccagaaacagcgggactcccggcttaactccctgctgttcccgc

SEQ ID NO: 311981 - DNA, 4684 bp, Homo sapiens
tggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagtgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtgaaaaaaccaaacagggaacaaagacaaaagacacaacagaagcaaaaaagaaacaacagggggggggggcaagaaataagc

SEQ ID NO: 311982 - DNA, 4647 bp, Homo sapiens
tggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagtgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgacaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtgaaaaaaccaaacagggaacaaagacaaaagacacaacagaagcaaaaaagaaacaacagggggggggggcaagaaataagc

SEQ ID NO: 311983 - DNA, 4488 bp, Homo sapiens
tgggttgtctttttgttgacttatctcttatcggatatctgatttgcaaatattttatcccattctgtgggttaccttttcactttcttgatggtgtcctttgaagcacaaaagtttttaattttgatgacgtttaatttatctttctttgtcccggtgcttttggtgtctccaaatattattgttgaattgtcctcctttcaattctatcagtttttgttttatatattatggggttctgttgttaggtgcatatatgtttatattcaaattgcttctttttgaatatttgtcctccacttaaaaaagatagcctactagcctggcaagcagcatcatttcttctgacctcttttctacctcattctggttattcttagttccgatcctgccccagccaatggaatagccactgtacaaaatcagggtcagagcaaaccagctaagcatgctctctgctcagcaaccagggccttgagaagtggatgcttgggtgtccttgaagttcttctgtctgccttgagcccgccttctgaccaggtccccttgaccagggctggccgagtttgtggttcttagctctgagaaggtgagggcaggggcaataaggttactatgcccctagaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagtgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtgaaaaaaccaaacagggaacaaagacaaaagacacaacagaagcaaaaaagaaacaacagggggggggggcaagaaataagc

SEQ ID NO: 311984 - DNA, 3321 bp, Homo sapiens
tcccagcctccctgacctcctggcccctgatctgggtcatcaagggcacaaaaggatgcataatagggttggtgctgagcggctgaaccccatccccgcttttgctccccgcagaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtgaaaaaaccaaacagggaacaaagacaaaagacacaacagaagcaaaaaagaaacaacagggggggggggcaagaaataagc

SEQ ID NO: 311985 - DNA, 3868 bp, Homo sapiens
tggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagtgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagccagatcccgcacatccttgaaggcctatctttaaaaggcccgagagccctctcctgcccacaactccatcttttcatccaaggactgtgttggtacgtatttagcagaagaattcagccctcaggtgacaacgtccattttttaagtcccagtgttgtcttcttaagaggtggaacgtctcgcacccagaaccgagattctgtctctctcttacccgctgccggcaacaaaatgtgcggctcatgaaaagtctcagtaaattctgcagctgata

SEQ ID NO: 311986 - DNA, 2751 bp, Homo sapiens
tggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagtgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggataccggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaacctgacatgcaacaacagcaagaacaagacgctggtgacacagaacagcggtgtggagg

SEQ ID NO: 311987 - DNA, 337 bp, Homo sapiens
tgtgaagctcaaggaggccatgggaggtctgcctgaggtctgtgttgcctgcactgctgccaggggctcaccagagattagccctatttatgggagaggctggggagagggccgagtcccaggctcggggagagagggctgtcaagccaccttcctgacctgctctccctacacagaagcccttcccactggcgagtccagttgccagccaggtcaatggggcgttggccccaacgagcaatgggtcaccaggtatgagcttcggtccgcacacctactgggggcacctccacctctgcacccacaggcacttccctttaaaaaatttcacctaggg

SEQ ID NO: 311988 - DNA, 3350 bp, Homo sapiens
atgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcacccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacgaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggccacttggcgagcgcggcggcggcggcggcggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttttgacacaccctcaaagccgaactaaatcgaaccccaaagcaggaaaagctaaaggaacccatcaaggcaaaatcgaaactaaaaaaaaaaaaaatccaattaaaaaaaacccctgagaatattcaccacaccagcgaacagaatatccctccaaaaattcagctcaccagcaccagcacgaagaaaactctattttcttaaccgattaattcagagccacctccactttgccttgtctaaataaacaaacccgtaaactgttttatacagagacagcaaaatcttggtttattaaaggacagtgttactccagataacacgtaagtttcttcttgcttttcagagacctgctttcccctcctcccgtctcccctctcttgccttcttccttgcctctcacctgtaagatattattttatcctatgttgaagggagggggaaagtccccgtttatgaaagtcgctttctttttattcatggacttgttttaaaatgtaaattgcaacatagtaatttatttttaatttgtagttggatgtcgtggaccaaacgccagaaagtgttcccaaaacctgacgttaaattgcctgaaactttaaattgtgctttttttctcattataaaaagggaaactgtattaatcttattctatcctcttttctttctttttgttgaacatattcattgtttgtttattaataaattaccattcagtttgaatgagacctatatgtctggatactttaatagagctttaattattacgaaaaaagatttcagagataaaacactagaagttacctattctccacctaaatctctgaaaaatggagaaaccctctgactagtccatgtcaaattttactaaaagtctttttgtttagatttattttcctgcagcatcttctgcaaaatgtactatatagtcagcttgctttgaggctagtaaaaagatatttttctaaacagattggagttggcatataaacaaatacgttttctcactaatgacagtccatgattcggaaattttaagcccatgaatcagccgcggtcttaccacggtgatgcctgtgtgccgagagatgggactgtgcggccagatatgcacagataaatatttggcttgtgtattccatataaaattgcagtgcatattatacatccctgtgagccagatgctgaatagatattttcctattatttcagtcctttataaaaggaaaaataaaccagtttttaaatgtatgtatataattctcccccatttacaatccttcatgtattacatagaaggattgcttttttaaaaatatactgcgggttggaaagggatatttaatctttgagaaactattttagaaaatatgtttgtagaacaattatttttgaaaaagatttaaagcaataacaagaaggaaggcgagaggagcagaacattttggtctagggtggtttctttttaaaccattttttcttgttaatttacagttaaacctaggggacaatccggattggccctcccccttttgtaaataacccaggaaatgtaataaattcattatcttagggtgatctgccctgccaatcagactttggggagatggcgatttgattacagacgttcgggggggtggggggcttgcagtttgttttggagataatacagtttcctgctatctgccgctcctatctagaggcaacacttaagcagtaattgctgttgcttgttgtcaaaatttgatcattgttaaaggattgctgcaaataaatacactttaatttcagtcaaaaa

SEQ ID NO: 311989 - DNA, 3689 bp, Homo sapiens
  misc_feature (3461)..(3466): n is a, c, g, or t
  misc_feature (3483)..(3483): n is a, c, g, or t
  misc_feature (3582)..(3582): n is a, c, g, or t
  misc_feature (3658)..(3658): n is a, c, g, or t
atgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcagcttcctgcggcggcggcggcgcttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacgaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggccacttggcgagcgcggcggcggcggcggcggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttttgacacaccctcaaagccgaactaaatcgaaccccaaagcaggaaaagctaaaggaacccatcaaggcaaaatcgaaactaaaaaaaaaaaaaatccaattaaaaaaaacccctgagaatattcaccacaccagcgaacagaatatccctccaaaaattcagctcaccagcaccagcacgaagaaaactctattttcttaaccgattaattcagagccacctccactttgccttgtctaaataaacaaacccgtaaactgttttatacagagacagcaaaatcttggtttattaaaggacagtgttactccagataacacgtaagtttcttcttgcttttcagagacctgctttcccctcctcccgtctcccctctcttgccttcttccttgcctctcacctgtaagatattattttatcctatgttgaagggagggggaaagtccccgtttatgaaagtcgctttctttttattcatggacttgttttaaaatgtaaattgcaacatagtaatttatttttaatttgtagttggatgtcgtggaccaaacgccagaaagtgttcccaaaacctgacgttaaattgcctgaaactttaaattgtgctttttttctcattataaaaagggaaactgtattaatcttattctatcctcttttctttctttttgttgaacatattcattgtttgtttattaataaattaccattcagtttgaatgagacctatatgtctggatactttaatagagctttaattattacgaaaaaagatttcagagataaaacactagaagttacctattctccacctaaatctctgaaaaatggagaaaccctctgactagtccatgtcaaattttactaaaagtctttttgtttagatttattttcctgcagcatcttctgcaaaatgtactatatagtcagcttgctttgaggctagtaaaaagatatttttctaaacagattggagttggcatataaacaaatacgttttctcactaatgacagtccatgattcggaaattttaagcccatgaatcagccgcggtcttaccacggtgatgcctgtgtgccgagagatgggactgtgcggccagatatgcacagataaatatttggcttgtgtattccatataaaattgcagtgcatattatacatccctgtgagccagatgctgaatagatattttcctattatttcagtcctttataaaaggaaaaataaaccagtttttaaatgtatgtatataattctcccccatttacaatccttcatgtattacatagaaggattgcttttttaaaaatatactgcgggttggaaagggatatttaatctttgagaaactattttagaaaatatgtttgtagaacaattatttttgaaaaagatttaaagcaataacaagaaggaaggcgagaggagcagaacattttggtctagggtggtttctttttaaaccattttttcttgttaatttacagttaaacctaggggacaatccggattggccctcccccttttgtaaataacccaggaaatgtaataaattcattatcttagggtgatctgccctgccaatcagactttggggagatggcgatttgattacagacgttcgggggggtggggggcttgcagtttgttttggagataatacagtttcctgctatctgccgctcctatctagaggcaacacttaagcagtaattgctgttgcttgttgtcaaaatttgatcattgttaaaggattgctgcaaataaatacactttaatttcagtcaaaaaaaaaaannnnnncggcacgagtataaggngcctaaacaatagaaagctgtagagattgggtttcattgttaattggtttgggagcctcctatgtgtgacttatgacttctctgtgttctgtgtatttntctgaattaatgacctgggatataaagctatgctagctttcaaacaggagatgcctttcagaaatttgtatatttngcagttgccagaccaataaaatacctggttg

SEQ ID NO: 311990 - DNA, 3454 bp, Homo sapiens
atgcaggcgcgctactccgtgtccagccccaactccctgggagtggtgccctacctcggcggcgagcagagctactaccgcgcggcggccgcggcggccgggggcggctacaccgccatgccggcccccatgagcgtgtactcgcaccctgcgcacgccgagcagtacccgggcggcatggcccgcgcctacgggccctacacgccgcagccgcagcccaaggacatggtgaagccgccctatagctacatcgcgctcatcaccatggccatccagaacgccccggacaagaagatcaccctgaacggcatctaccagttcatcatggaccgcttccccttctaccgggacaacaagcagggctggcagaacagcatccgccacaacctctcgctcaacgagtgcttcgtcaaggtgccgcgcgacgacaagaagccgggcaagggcagctactggacgctggacccggactcctacaacatgttcgagaacggcagcttcctgcggcggcggcggcgcttcaagaagaaggacgcggtgaaggacaaggaggagaaggacaggctgcacctcaaggagccgcccccgcccggccgccagcccccgcccgcgccgccggagcaggccgacggcaacgcgcccggtccgcagccgccgcccgtgcgcatccaggacatcaagaccgagaacggtacgtgcccctcgccgccccagcccctgtccccggccgccgccctgggcagcggcagcgccgccgcggtgcccaagatcgagagccccgacagcagcagcagcagcctgtccagcgggagcagccccccgggcagcctgccgtcggcgcggccgctcagcctggacggtgcggattccgcgccgccgccgcccgcgccctccgccccgccgccgcaccatagccagggcttcagcgtggacaacatcatgacgtcgctgcgggggtcgccgcagagcgcggccgcggagctcagctccggccttctggcctcggcggccgcgtcctcgcgcgcggggatcgcacccccgctggcgctcggcgcctactcgcccggccagagctccctctacagctccccctgcagccagacctccagcgcgggcagctcgggcggcggcggcggcggcgcgggggccgcggggggcgcgggcggcgccgggacctaccactgcaacctgcaagccatgagcctgtacgcggccggcgagcgcgggggccacttgcagggcgcgcccgggggcgcgggcggctcggccgtggacgaccccctgcccgactactctctgcctccggtcaccagcagcagctcgtcgtccctgagtcacggcggcggcggcggcggcggcgggggaggccaggaggccggccaccaccctgcggcccaccaaggccgcctcacctcgtggtacctgaaccaggcgggcggagacctgggccacttggcgagcgcggcggcggcggcggcggccgcaggctacccgggccagcagcagaacttccactcggtgcgggagatgttcgagtcacagaggatcggcttgaacaactctccagtgaacgggaatagtagctgtcaaatggccttcccttccagccagtctctgtaccgcacgtccggagctttcgtctacgactgtagcaagttttgacacaccctcaaagccgaactaaatcgaaccccaaagcaggaaaagctaaaggaacccatcaaggcaaaatcgaaactaaaaaaaaaaaaaatccaattaaaaaaaacccctgagaatattcaccacaccagcgaacagaatatccctccaaaaattcagctcaccagcaccagcacgaagaaaactctattttcttaaccgattaattcagagccacctccactttgccttgtctaaataaacaaacccgtaaactgttttatacagagacagcaaaatcttggtttattaaaggacagtgttactccagataacacgtaagtttcttcttgcttttcagagacctgctttcccctcctcccgtctcccctctcttgccttcttccttgcctctcacctgtaagatattattttatcctatgttgaagggagggggaaagtccccgtttatgaaagtcgctttctttttattcatggacttgttttaaaatgtaaattgcaacatagtaatttatttttaatttgtagttggatgtcgtggaccaaacgccagaaagtgttcccaaaacctgacgttaaattgcctgaaactttaaattgtgctttttttctcattataaaaagggaaactgtattaatcttattctatcctcttttctttctttttgttgaacatattcattgtttgtttattaataaattaccattcagtttgaatgagacctatatgtctggatactttaatagagctttaattattacgaaaaaagatttcagagataaaacactagaagttacctattctccacctaaatctctgaaaaatggagaaaccctctgactagtccatgtcaaattttactaaaagtctttttgtttagatttattttcctgcagcatcttctgcaaaatgtactatatagtcagcttgctttgaggctagtaaaaagatatttttctaaacagattggagttggcatataaacaaatacgttttctcactaatgacagtccatgattcggaaattttaagcccatgaatcagccgcggtcttaccacggtgatgcctgtgtgccgagagatgggactgtgcggccagatatgcacagataaatatttggcttgtgtattccatataaaattgcagtgcatattatacatccctgtgagccagatgctgaatagatattttcctattatttcagtcctttataaaaggaaaaataaaccagtttttaaatgtatgtatataattctcccccatttacaatccttcatgtattacatagaaggattgcttttttaaaaatatactgcgggttggaaagggatatttaatctttgagaaactattttagaaaatatgtttgtagaacaattatttttgaaaaagatttaaagcaataacaagaaggaaggcgagaggagcagaacattttggtctagggtggtttctttttaaaccattttttcttgttaatttacagttaaacctaggggacaatccggattggccctcccccttttgtaaataacccaggaaatgtaataaattcattatcttagggtgatctgccctgccaatcagactttggggagatggcgatttgattacagacgttcgggggggtggggggcttgcagtttgttttggagataatacagtttcctgctatctgccgctcctatctagaggcaacacttaagcagtaattgctgttgcttgttgtcaaaatttgatcattgttaaaggattgctgcaaataaatacactttaatttcagtcaaaaa

SEQ ID NO: 311991 - DNA, 840 bp, Homo sapiens
gcctggtggcgaattcggcacgagggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggacggcacgataaaagaagggaagtgggacaaccacaagtgagctggcgggcccaaagggaggacctgtcacgcgggaaccaaacaggccggcagtcgcagacaggtgcccaaattggtacgttgcagaacaggatccccaacataccgaccttgccactttcaaagggacaccaacgacccttggtactcatggcggagaacacagcaacaaggggagagcaccctacacgtagctacaaaccaggagagaggccggatagcacacgcagggaagacgtccgcaaa

SEQ ID NO: 311992 - DNA, 2462 bp, Homo sapiens
ccctgcccaggtgcccgcagagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 311993 - DNA, 3034 bp, Homo sapiens
cccaaactaggctagtacgaggctgcgtgtgtatcggccgagggccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgtagtaaaaaaacaaaaaaaaaaaaaaaaagaaaaaaaaaaaaacaagaagagggcgcgggcgcccccaagaaaaatttcccccgagaagggggccccacaatttgacccgcttaccccgggtttttttgtgtgaacaagagagggggccccccataaagaaggaggcgcgcatttttatgacgccctctggaccacttgtgcggcccgcgcggttgtttacaacaaccgtcgcgtgtagcatgtgggaaaaacggtgtctgacacgagggagacacctttgtcgtgagaaagagagacaccccctacaatttcgcgtgggcgggggggagcacgagacaaattgtggtggccacacgactctactcgcctgcggagaggatttttcgaagcgcctccaacggcgagaacactctttgacgaacttttccgaaggctgctcataacggtgtttggcaccaccaccgccgtggagattagtcttcgctggattatgacaccaatgttggcgcccaccgggaagcatatgtctgtaggcgaaagtttttttaacacggga

SEQ ID NO: 311994 - DNA, 2399 bp, Homo sapiens
cccaaactaggctagtacgaggctgcgtgtgtatcggccgagggccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 311995 - DNA, 2469 bp, Homo sapiens
ggccagcgtcatgacaacggggagaccccacgaacccctttgggggcccccggggcccctcaaacccccaaccccccaaagggccttctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 311996 - DNA, 2114 bp, Homo sapiens
tgtagctgttcttgaggatccccgtctggatgtaaatgtagtggatcgtgatgagtatacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 311997 - DNA, 2435 bp, Homo sapiens
cccaaactaggctagtacgaggctgcgtgtgtatcggccgagggccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggagcctgtcggggagaacggcggccgtgcgctggtgcccatgttcgtgcgcaagtcccagttccgcctgcccttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 311998 - DNA, 2152 bp, Homo sapiens
cccaaactaggctagtacgaggctgcgtgtgtatcggccgagggccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggctccacgtgatttccagtgagtgtaaataattttaaataacctctggcccttggaataaagttctgttttctgta

SEQ ID NO: 311999 - DNA, 1754 bp, Homo sapiens
aacaagatgtcatgagtgcgaggctcggtgtaattcatccgaggaaggcagctggcgatggagttcaacattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 312000 - DNA, 2071 bp, Homo sapiens
aaacatccactattcagtggaaagctcccctctgccacccactcatccccactgttcttattatttatggatccttctagagttcctgtatgaacatacaagtaaaacaaacagagactcttatttttaatttaaaaaaacctttattttattttagagacagggtctcactgtgttgcccaggctggaagcgaaactctgtctcaaaaaaaaaaagagaactgcattggaccaggctgggagagcccttgatgtaaccggtgagatttcctcatggagatctctgagattccctgtgctttgtgcaaccagaagggtccttggagacagagactcagatcaaagccccggccgctcactgtgcttctctcctccccacccagcccctttgatgccaagaatccgttcctggctgcagtcaccaccaaccggaagctgaaccagggaaccgagcgccacctcatgcacctggaattggacatctcggactccaaaatcaggtaccagctgccactgtcaccccctgaaccctcactctgggcctcctgacctggggcagggccagccttccgcccctcccgagcctcacatctccctccaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 312001 - DNA, 710 bp, Homo sapiens
ccctgcccaggtgcccgcagagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggcttgctcctcctgcagggcctgtgagctgctcacaactgggtcaacgctttaggctgagtcactcctcgggtctctccataattcagcccaacaatgcttggtttatttcaatcagctctgacacttgtttagacgattggccattctaaagttggtgagtttgtcaagcaactatcgacttgatcagttcagccaagcaactgacaaatcaaaaacccacttgtcagttcagtaaaataatttggtcaaacaaaa

SEQ ID NO: 312002 - DNA, 217 bp, Homo sapiens
ctgcactccagcctgggtggcagagcgaaactctgtctcaaaaaaaaaaagagaactgcattggaccaggctgggagagcccttgatgtaaccggtgagatttcctcatggagatctctgagattccctgtgctttgtgcaaccagaagggtccttggagacagagactcagatcaaagccccggccgctcactgtgcttctctcctccccacccag

SEQ ID NO: 312003 - DNA, 660 bp, Homo sapiens
ccctgcccaggtgcccgcagagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgagtcacccagagactgctatgggctcccggtggcctgcggtgcctccctggggactccagatccatgtatctgaaaggcagccctccagaccccca

SEQ ID NO: 312004 - DNA, 2479 bp, Homo sapiens
cccaaactaggctagtacgaggctgcgtgtgtatcggccgagggccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 312005 - DNA, 2519 bp, Homo sapiens
cccaaactaggctagtacgaggctgcgtgtgtatcggccgagggccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgtaaaaaaaaaaaaaaattcggggctctaggcggggggggaag

SEQ ID NO: 312006 - DNA, 2574 bp, Homo sapiens
cccaaactaggctagtacgaggctgcgtgtgtatcggccgagggccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtgggtgagtgagtggggtcactggaatagggggcagggaggacaaggccctgcctgccacagttggcccagcccccagcaccccctcttcctgcccagggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 312007 - DNA, 2291 bp, Homo sapiens
gtgtggctgcagcagtgaagaaaatagatgaatgctgtcttcatcaagcttacgctctagtggacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 312008 - DNA, 2415 bp, Homo sapiens
cccaaactaggctagtacgaggctgcgtgtgtatcggccgagggccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 312009 - DNA, 2268 bp, Homo sapiens
cccaaactaggctagtacgaggctgcgtgtgtatcggccgagggccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgacctcctctgtcagagagagcagctttgtggaaaagatgaagaaaacggggaggaacatcatcgtgttctacggctcccagacggggactgcagaggagtttgccaaccgcctgtccaaggacgcccaccgctacgggatgcgaggcatgtcagcggaccctgaggagtatgacctggccgacctgagcagcctgccagagatcgacaacgccctggtggttttctgcatggccacctacggtgagggagaccccaccgacaatgcccaggacttctacgactggctgcaggagacagacgtggatctctctggggtcaagttcgcggtgtttggtcttgggaacaagacctacgagcacttcaatgccatgggcaagtacgtggacaagcggctggagcagctcggcgcccagcgcatctttgagctggggttgggcgacgacgatgggaacttggaggaggacttcatcacctggcgagagcagttctggccggccgtgtgtgaacactttggggtggaagccactggcgaggagtccagcattcgccagtacgagcttgtggtccacaccgacatagatgcggccaaggtgtacatgggggagatgggccggctgaagagctacgagaaccagaagcccccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 312010 - DNA, 1970 bp, Homo sapiens
aaacatccactattcagtggaaagctcccctctgccacccactcatccccactgttcttattatttatggatccttctagagttcctgtatgaacatacaagtaaaacaaacagagactcttatttttaatttaaaaaaacctttattttattttagagacagggtctcactgtgttgcccaggctggaagcgaaactctgtctcaaaaaaaaaaagagaactgcattggaccaggctgggagagcccttgatgtaaccggtgagatttcctcatggagatctctgagattccctgtgctttgtgcaaccagaagggtccttggagacagagactcagatcaaagccccggccgctcactgtgcttctctcctccccacccagcccctttgatgccaagaatccgttcctggctgcagtcaccaccaaccggaagctgaaccagggaaccgagcgccacctcatgcacctggaattggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 312011 - DNA, 1518 bp, Homo sapiens
gcctggtggcgaattcggcacgagggacatctcggactccaaaatcaggtatgaatctggggaccacgtggctgtgtacccagccaacgactctgctctcgtcaaccagctgggcaaaatcctgggtgccgacctggacgtcgtcatgtccctgaacaacctggatgaggagtccaacaagaagcacccattcccgtgccctacgtcctaccgcacggccctcacctactacctggacatcaccaacccgccgcgtaccaacgtgctgtacgagctggcgcagtacgcctcggagccctcggagcaggagctgctgcgcaagatggcctcctcctccggcgagggcaaggagctgtacctgagctgggtggtggaggcccggaggcacatcctggccatcctgcaggactgcccgtccctgcggccccccatcgaccacctgtgtgagctgctgccgcgcctgcaggcccgctactactccatcgcctcatcctccaaggtccaccccaactctgtgcacatctgtgcggtggttgtggagtacgagaccaaggccggccgcatcaacaagggcgtggccaccaactggctgcgggccaaggagcctgccggggagaacggcggccgtgcgctggtgcccatgttcgtgcgcaagtcccagttccgcctgcccttcaaggccaccacgcctgtcatcatggtgggccccggcaccggggtggcacccttcataggcttcatccaggagcgggcctggctgcgacagcagggcaaggaggtgggggagacgctgctgtactacggctgccgccgctcggatgaggactacctgtaccgggaggagctggcgcagttccacagggacggtgcgctcacccagctcaacgtggccttctcccgggagcagtcccacaaggtctacgtccagcacctgctaaagcaagaccgagagcacctgtggaagttgatcgaaggcggtgcccacatctacgtctgtggggatgcacggaacatggccagggatgtgcagaacaccttctacgacatcgtggctgagctcggggccatggagcacgcgcaggcggtggactacatcaagaaactgatgaccaagggccgctactccctggacgtgtggagctaggggcctgcctgccccacccaccccacagactccggcctgtaatcagctctcctggctccctcccgtagtctcctgggtgtgtttggcttggccttggcatgggcgcaggcccagtgacaaagactcctctgggcctggggtgcatcctcctcagcccccaggccaggtgaggtccaccggcccctggcagcacagcccagggcctgcatgggggcaccgggctccatgcctctggaggcctctggccctcggtggctgcacagaagggctctttctctctgctgagctgggcccagcccctccacgtgatttccagtgagtgtaaataattttaaataacctctggcccttggaataaagttctgttttctgta

SEQ ID NO: 312012 - DNA, 520 bp, Homo sapiens
ccctgcccaggtgcccgcagagagcagccgggctgccagcgtttcatgatcaacatgggagactcccacgtggacaccagctccaccgtgtccgaggcggtggccgaagaagtatctcttttcagcatgacggacatgattctgttttcgctcatcgtgggtctcctaacctactggttcctcttcagaaagaaaaaagaagaagtccccgagttcaccaaaattcagacattgtaagtgccgcctctcagcctcctctctctgtccctcttctgtcaccactccaagcagtgtcctgcatgcgggcctcaggctgaaagaagcaaggctccttgtagcattttggggtgactcttgggttttgccttcttgctagattgtgcttgagctctcccttaatcatctcttatgtggggtttataaggcccttttctatctgctgtttatatgaccttcacaggaagcactgcgaaaatgacaccagtttacagattaagaaccgggggctcaagaatgttaa

SEQ ID NO: 312013 - DNA, 2394 bp, Homo sapiens
ccttcattttgcttaatctctcccttgaaattgctctcttggtaggtggatcctgtttttccttcaaagaattccttttcctgttgcatactggttcccagtttttccataggcctcttttttttcttatttttttatattgaaaaattccacacatccagaaaaagttgaaaggctagcacaatgaatactcagatacatactctccacttggattgaatagttgttaacattttgccagatttactattctctccaccccatgcatgtgtacatagaatgacatttcgacccctgagtattaccacatagatttcctgagcacaaagacaccgttctacatgattacattaagatgatcatgcctaaaaatataaacagtaacttctttatagcctctaatacagagcccttaatcagtattcaacaattgtctccagaatgtttgtctttaaaaacaacgacaacaaccaggtcccatcaaggttcatacattcttttggtttcaactctagtcactttcagtctacaacaaccccgacatattttcccatgatactttttgaagcatccaggccagctgtcttagcaaatgtcctctattctggaagtgtctgattgcttccttaggcctatgtctacactccactcgtggctcatatccctgcagagttgtaatctcctctgggccagggactcctgaatatctccaggccgagtgttctccccgggcctggagaaaaccttcatgcccaatcccttgctgcatgtctccacccctccttgcacatcctgcctctatgagtggacgaggcaaatctactcaaccccacatcccacccctcacctgataactaacatttactgggcactaacaatgtatcaggcacatactacacacttaacatgcattgctttcacataccagctccatggtaacattgcgctggctttacagctaaagaaactgagctagaaaggggttaagtatcctgtacaagatcacagctggccagcaatagaggtgggatcccactgcagacagtctccccctcagatgccatgctcccactgtaccaccatgtactgcttcctgagatctctgcttccttcagtcgacccagctgacacctgtttccttcctaactccaactaattaattccagttaatggaattgactggaattagtgacattaatatttactgagcattccccatgtgtcatcagagctgtgctaaatgctttacaagaataattacctgccataaagcaaccctatgacataggtgctactatgcccattttgtagatgagacaggttcaggggagttagtatcaccttcaagtcatacagtggctaagaatctgtggtctcgctgaatgctgggcgcctgctctgctaagtctatttctacaaaacattgcactgccttcctgttgcctgccaagctcagggcccatttatcatgcatcttcccatccttgtctcccccaactgtcccttacctgagtcacaatttcgccaaagccaaagggattgtcctaagccaatgttgatttatcactcttcctgctcaaaagcccccaagatcacctatcaatcacctacttgagtgcaagctttgactctgtcacctgacattcaagtccccctctgcccccatgccagtcttatcccctcccctacatatgccctatcctgcagccaaattggactctgttcttcctgacaagacctggtattggcatctctatgcctcagtttgccttccctccactttaaaaagcctcttcagtctcgatacaaaaaacatcccacacatgttctaaaaccatgctttccttgatttctcctcatgtcaagacatttcttacttctctagtctcctagcattttgtgcctcacaaccctcaggacaggccagctagtgtatggctgtgggtttttatctcacctcccctgcctgaccctgagcccttgtggggagtatactcaccctactcctacagtgccttgcattccgtagctgctcagtacattaacccattcaatgtctttaagatttttacaagttagttttcctgtaattactaatcatttatctttaattctgagtaaaattcacaacaacaaataaaaggaaatagtagtaattttttaagctgtttagtcaataaagatttaatgcgtcagttattggactgtttggtttgaagccaatcaaccattctggtatgtaaatctacttttttattatacaagtaacacaaaatgtattgcctcagtcaaggaagaagaacagaaaaaaacaacaccccaaaatcctgtcacctctgtaaaactgctattaattaacattttaatatattttcttttgtcttttgcaatttt

SEQ ID NO: 312014 - DNA, 831 bp, Homo sapiens
ggcacgagacaggttcaggggagttagtatcacctatcaatcacctacttgagtgcaagctttgactctgtcacctgacattcaagtccccctctgcccccatgccagtcttatcccctcccctacatatgccctatcctgcagccaaattggactctgttcttcctgacaagacctggtattggcatctctatgcctcagtttgccttccctccactttaaaaagcctcttcagtctcgatacaaaaaacatcccacacatgttctaaaaccatgctttccttgatttctcctcatgtcaagacatttcttacttctctagtctcctagcattttgtgcctcacaaccctcaggacaggccagctagtgtatggctgtgggtttttatctcacctcccctgcctgaccctgagcccttgtggggagtatactcaccctactcctacagtgccttgcattccgtagctgctcagtacattaacccattcaatgtctttaagatttttacaagttagttttcctgtaattactaatcatttatctttaattctgagtaaaattcacaacaacaaataaaaggaaatagtagtaattttttaagctgtttagtcaataaagatttaatgcgtcagttattggactgtttggtttgaagccaatcaaccattctggtatgtaaatctacttttttattatacaagtaacacaaaatgtattgcctcagtcaaggaagaagaacagaaaaaaacaacaccccaaaatcctgtcacctctgtaaaactgctattaattaacattttaatatattttcttttgtcttttgcaatttt

SEQ ID NO: 312015 - DNA, 742 bp, Homo sapiens
aatggggtgcaggataggtcatatgtacggggagggaataagactggcatgggggcagagggggactctgttcttcctgacaagacctggtattggcatctctatgcctcagtttgccttccctccactttaaaaagcctcttcagtctcgatacaaaaaacatcccacacatgttctaaaaccatgctttccttgatttctcctcatgtcaagacatttcttacttctctagtctcctagcattttgtgcctcacaaccctcaggacaggccagctagtgtatggctgtgggtttttatctcacctcccctgcctgaccctgagcccttgtggggagtatactcaccctactcctacagtgccttgcattccgtagctgctcagtacattaacccattcaatgtctttaagatttttacaagttagttttcctgtaattactaatcatttatctttaattctgagtaaaattcacaacaacaaataaaaggaaatagtagtaattttttaagctgtttagtcaataaagatttaatgcgtcagttattggactgtttggtttgaagccaatcaaccattctggtatgtaaatctacttttttattatacaagtaacacaaaatgtattgcctcagtcaaggaagaagaacagaaaaaaacaacaccccaaaatcctgtcacctctgtaaaactgctattaattaacattttaatatattttcttttgtcttttgcaatttt

SEQ ID NO: 312016 - DNA, 396 bp, Homo sapiens
ttttttttttgctgtttttctcaactgtcagtggaattattgtcttcctgtctccatatttaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttcttt

SEQ ID NO: 312017 - DNA, 727 bp, Homo sapiens
agcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctgattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtcttaagtgacgggataatatgtttatcaaagggaatgattatagtttggggtgagagagaattggcttggtgagggatttacagaagagcatctgtaaagtggatcgtaattctagaggagattcttatcagattgaatcggttgatataatgtttgtaag

SEQ ID NO: 312018 - DNA, 449 bp, Homo sapiens
tgcttatattgttataaaatcttttcctacattggctacatcatagatattagatatgggccatcttttgccctataaaatcttaaggttaaagatttagccacattttctacgatataaagctttatttatctgaaaagtctgacaattttgaaagcatgtcacaagtttacattaatgcactacctctatttactgttttagatctgaggctggtggatcccctgaggtcagtagtttgcgacatcctggctaacacagtgaaatcccatctctactaaaaaacagaaaaaattagccgggcgtggtggcaggcacctgtagtcccagctatttgggaggctaaggcaggagaatggcgtgaacccaggaggcggagcttgcagtgcgccaagatcacgccactgcactccagctagggtgacagagcgagactctgtctcaaaaaa

SEQ ID NO: 312019 - DNA, 3668 bp, Homo sapiens
ctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtagtgtcagtggctgagtatcaccgcaggatcgatgctctaaatactgaagaactgcgcacactctgcagacgcctccagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaaatgagtttggatttattgaatactc

SEQ ID NO: 312020 - DNA, 2631 bp, Homo sapiens
agcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctggtagtgtcagtggctgagtatcaccgcaggatcgatgctctaaatactgaagaactgcgcacactctgcagacgcctccagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaaatgagtttggatttattgaatactc

SEQ ID NO: 312021 - DNA, 1559 bp, Homo sapiens
ctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggaggtagtgtcagtggctgagtatcaccgcaggatcgatgctctaaatactgaagaactgcgcacactctgcagacgcctccaggtgcccccttcagtagtttaaacccctccagagactaaatactccctgtttttagtgttctttgtcatggcaaatctcatttgaagaatttgctttgactgcagcactaaaattaaattcctttttgtattaaaggttatagtattgccgtgaagagctgtggattatcttttctgtcatcttttcatttgaaaaatattctgaagaatgttctgtcacttcagaattattctcagtattgtgtgtttcttt

SEQ ID NO: 312022 - DNA, 3587 bp, Homo sapiens
ctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaaatgagtttggatttattgaatactc

SEQ ID NO: 312023 - DNA, 2550 bp, Homo sapiens
agcaaactgttttgtcactgtagtaaggctctagtgctggaaatttatctttgacagaggaagaatgcttttgaaaacagttcttacgtgattttatgtaacttaatttgccctggaaaggaaatgtctcgtctctggtatgggaaaaaagggagaagacatcaaccaattaatcataaatacactctgattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaatgacaggtttagacaccccagtgctgatggtgattaaagacagtgatggacaggtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaaatgagtttggatttattgaatactc

SEQ ID NO: 312024 - DNA, 3534 bp, Homo sapiens
ctttggagatacgtgctacatccttttgttaaaaagtctttttagtgatactaattctgtgttcagtgtgtgaaaagtaaaataccacaattttaaaagtctaattatttttaattttgtttaatgacagagatatagatcagctatcaggaagggacttctgccattcaaagaaaatgacaggaagtaacactgaggaaatagactcaagaatccgagatgcaggtaatgatagtgccagcactgctcctaggagcactgaggagtctctttctgaagatgtgttcacagaatcagaactttcccctatacgagaggagcttgtatcttcagatgaactgcgacaagataaatcttctggtgcgtcatcagaatctgtgcaaactgtcaatcaggctgaagtagaaagtctgacagtcaaatcagaatctactggtactcctggtcacttaagatctgatactgaacattctacaaatgaagttgggactttatgtcataaaactgatttaaataatcttgaaatggccattaaggaagatcagattgcagataactttcaaggaatatcaggtcctaaagaagacagcacaagtataaaaggtaattcagaccaggattcttttcttcatgagaattcgttacaccaagaagagagtcaaaaagaaaatatgccttgtggggaaacagcagaatttaaacaaaagcaaagtgttaacaaaggaaaacaaggaaaggagcaaaatcaggactcacagacagaggcagaagagctacgcaaactttggaaaacccatactatgcaacaaactaaacagcaaagggaaaatattcaacaagtgtcacaaaaagaagctaagcataaaattacatctgctgatggacacatagaaagttctgcacttttaaaagaaaagcaaaggcatcgattacataagttcttgtgtctcagagttggaaaaccaatgaggaaaacgtttgtatctcaagcaagtgctacaatgcaacagtatgcacagagagataagaaacatgaatattggtttgctgtgccacaagaaaggacagatcacttgtatgccttcttcattcagtggagtccagaaatatatgcagaagatactggcgaatataccagagaacctggatttatagtagtaaaaaagattgaggagtctgaaacaattgaggattctagtaatcaagcagcagccagagaatgggagattactacaagggaagacataaattcaaagcaggttgctacagtgaaagcagacctggagtctgaatcttttcgaccaaacctaagtgatcccagtgaacttttactgccagatcaaattgaaaagcttaccaagcatcttccaccaagaacaattggctatccatggactcttgtttatggtactggaaaacatggcacaagcttgaaaactctttatcgaacaagtttttggtgcgttagcatctgagccactgaaagtgagtgatggcttttatggtactggagagacctttgtttttacattctgtccggagtttgaggtctttaagtggacaggagataatatgttttttatcaaaggagacatggattcactagctttcggtggtggaggaggagaatttgcgctttggcttgatggagatctctaccatggaagaagccattcttgtaaaacgtttgggaatcgtacactttctaagaaggaagatttctttatccaagatattgaaatctgggcttttgaataaataaaatgctctctgtcttagcaggagaatggcccaaacctgacatggacaagcattgtttggaaagttcaagaagcaatacagtgtaacatgtcacttgtgctttaaaattagtctgtatcaccatttattacagttataattttggagtttatttttcaaatcatgttcttgtcccagagttctttaggttaacactagggactgcgtccatgtactagtataacagcttgggtttgttagaatttgggcaacattttgattataatgacaacttcattttcacatgttactcagttccctaataggatggtgctcttttgttgaacctgtattgatttttttttttttaactatattgattcgtttactagaacagtctaattggggcattgaggaaatgaagactggatacttctgtatctgtgaagttggcacaggtaacatttggacatgttcatcttattcttaggaaggaaaaaatcacttgccaaaataatacatacttcatagaccactgagttctagtttttattcacactacaacattctctttaacgatgttgcaggtattctcaatttccttttaagaaaaatgaaatgtgaggagaattctggttgtaatagatgacagtacatatgatctgcaggtttgggcatatgctttcatcattaaattatctgataaagttacaagtcacaaaggagaatgagaacttaatgattctattggatttaatatattagcaagaaaacatactatttacatatgtgtagcttagtaaggcattaacataagtacaaaaactatgaaacagatgcatatttcctcaacatactgtgtcaggtatactgttttataatttggttgttttagccttattgcacaccaactcccaaaatataggttactcttgttcaaaaggaaaaaaaaaaattgtgattttctttgagtggtatatgttattaattaccattagcatttgctcttataaagggcaatgattatagtagacaatattgtaactcagtagacttgttgaatatgcaaacttactgtcaagtgacctcaaaaaaaaaatgaaaagatagaatacactagtagttcttatcctcttttgtaggaaaccaataatagccattgtggcaataattcatcagttgattttaaagcttcatgttatgcaaaaaagaatcctgctgttatacatgtgacagtgactttgtgctgaaatttcagctattccagataaacattgtatatcttgtaaattaatgtttaaaggtagttttgttcttacagaaagtgttgattgccaggttgcttatagcactttaagttattctaaaaatgaaattataagccaaatatttggcttaagtagatttagttgtatagcacttacatatttagttcttttgaaagtttagataattatttaaagaaagcataatgctaatggaaaagaaaatctgatgttctattataatatgctattgctgaatatgaatagaaatacagggcatcatttccttgtctcattataagttagtaacaatatatagattaaatgtttacaatatagggaattgtaaataaatatatcagtttttttccccttcggtcttccacagcagtattattgtctttgtggagttgactaatgataatttaaaaatcctgtaatggatttctactaaaataaggtcatagtggcatataccaaataaaatcaaatacagaaatacaaatgagtttggatttattgaatactc

SEQ ID NO: 312025 - DNA, 113 bp, Homo sapiens
gtttgctatgaagaaagccatcattctaccatcaaaatacatttatgaagatgaagtgagattggcaaagagaaaactgaatgtccctgaataaaacctctgtatctggataa

SEQ ID NO: 312026 - DNA, 1376 bp, Homo sapiens
agtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatcaaacatctggaaattaccttaatatgcaagactctcaaggagtactttcttcctttccagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaa

SEQ ID NO: 312027 - DNA, 1313 bp, Homo sapiens
agtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaa

SEQ ID NO: 312028 - DNA, 428 bp, Homo sapiens
agtttcagtcacacaagaagggaggagagaaaagccatggccgacaaggtcctgaaggagaagagaaagctgtttatccgttccatgggtgaagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaa

SEQ ID NO: 312029 - DNA, 2480 bp, Homo sapiens
agtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcgggagtgtgggaaggttgaggaaagggtactgaaagtccatttgagtcaagaactctaggtttacaggctgagaatccttaatccaaaaatttgaattttgaaatgctctaaaatccaacactgtgtgagcgcccacatgatattcaaaggaaatgtttattgaaacatttcaaattataggtttttggattagggatgctaaaccagtaagtatacagctgaattccaatatacaaaaatatctgaaatttgaaatacttctggtagcatgcattttggataagggataatcaagccatatacagaaaatactgaagtaatgcctttcttctggtcagtgcagagcacgttgctcttctcccaaagtttttcatttagaccccttttgagattcatctgatattggcctagaagtggccgtaagactacaaaccctcacttttggatgtttctctccttcacctcagcagggtatatttaaacatagcatgtggtctttccttttaaaattgtgtatgttcccattggtggtataactttataacttgcatgtctttaacaaaattctttcctatgtttttttttttaattatttctttttctcataggaagtgaagagatccttctgtaaaggtttttggaattatgtctgctgaataataaacttttttgaaataataaatctggtagaaaaatgaaaaaaaaaaaaaaaaaaaaaaaaaaaaaaaaaaaaaaaaaaaaaaaaaaaaaaaaaaaaaaaaagagagaggggggcgggcacctaaaagaacaccaccgaggaggaggcgcccacaaaatcagagcgccacaacgaattcgtcagaaaggagggcgccacatgagaggacgactatattaaacaaacagacgacgcggcgcgcggataacaacaacagatgcaggaaaaaaaaaccgacaaagcgcgggggacacaccagagagagagggaaaccacacacaaggaggggggggggaacaacaaaaggagggaagaggcacaaacgaccacgacgcaaagggaagaagatagacgacgagagccgacggagggagagcaagaacacccatcagagagacagcatcgaataacatggcgacaaaaaaacaaccaggaaacatgaggcggagggggaagagaaagaagatgccgccgcaacgcgagaaggttgtagagcagaacaaacatcaccagcgacggcaccagacgaagacacagggaggt

SEQ ID NO: 312030 - DNA, 2136 bp, Homo sapiens
ctctgctttccagggactgatgtggaaatggtaaactcagtcttcaggtcactccatgcacatgtatggagactattgagggaaacaagtaggacagcaatacagtaagaagagggattacccaactgtgaggagggggacatttcactgatgaaatctaaatgaggtcactttctgttgattacatgagaggaatatgaggctgttttcatgatgtgagaaatccttgtgctctaaacagacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcgggagtgtgggaaggttgaggaaagggtactgaaagtccatttgagtcaagaactctaggtttacaggctgagaatccttaatccaaaaatttgaattttgaaatgctctaaaatccaacactgtgtgagcgcccacatgatattcaaaggaaatgtttattgaaacatttcaaattataggtttttggattagggatgctaaaccagtaagtatacagctgaattccaatatacaaaaatatctgaaatttgaaatacttctggtagcatgcattttggataagggataatcaagccatatacagaaaatactgaagtaatgcctttcttctggtcagtgcagagcacgttgctcttctcccaaagtttttcatttagaccccttttgagattcatctgatattggcctagaagtggccgtaagactacaaaccctcacttttggatgtttctctccttcacctcagcagggtatatttaaacatagcatgtggtctttccttttaaaattgtgtatgttcccattggtggtataactttataacttgcatgtctttaacaaaattctttcctatgtttttttttttaattatttctttttctcataggaagtgaagagatccttctgtaaaggtttttggaattatgtctgctgaataataaacttttttgaaataataaatctggtagaaaaatgaaaa

SEQ ID NO: 312031 - DNA, 1781 bp, Homo sapiens
ttgtcgcccctcccgcagggactgcgccgccgccggtgcagccgccgacgctgaccgggaggaggaaggaagacgccgagcgggagagctgaagagccgacagccactcggaccgattgccttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcgggagtgtgggaaggttgaggaaagggtactgaaagtccatttgagtcaagaactctaggtttacaggctgagaatccttaatccaaaaatttgaattttgaaatgctctaaaatccaacactgtgtgagcgcccacatgatattcaaaggaaatgtttattgaaacatttcaaattataggtttttggattagggatgctaaaccagtaagtatacagctgaattccaatatacaaaaatatctgaaatttgaaatacttctggtagcatgcattttggataagggataatcaagccatatacagaaaatactgaagtaatgcctttcttctggtcagtgcagagcacgttgctcttctcccaaagtttttcatttagaccccttttgagattcatctgatattggcctagaagtggccgtaagactacaaaccctcacttttggatgtttctctccttcacctcagcagggtatatttaaacatagcatgtggtctttccttttaaaattgtgtatgttcccattggtggtataactttataacttgcatgtctttaacaaaattctttcctatgtttttttttttaattatttctttttctcataggaagtgaagagatccttctgtaaaggtttttggaattatgtctgctgaataataaacttttttgaaataataaatctggtagaaaaatgaaaa

SEQ ID NO: 312032 - DNA, 1097 bp, Homo sapiens
agtttcagtcacacaagaagggaggagagaaaagccatggccgacaaggtcctgaaggagaagagaaagctgtttatccgttccatgggtgaagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaa

SEQ ID NO: 312033 - DNA, 953 bp, Homo sapiens
agtttcagtcacacaagaagggaggagagaaaagccatggccgacaaggtcctgaaggagaagagaaagctgtttatccgttccatgggtgaagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaa

SEQ ID NO: 312034 - DNA, 1938 bp, Homo sapiens
agtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcgggagtgtgggaaggttgaggaaagggtactgaaagtccatttgagtcaagaactctaggtttacaggctgagaatccttaatccaaaaatttgaattttgaaatgctctaaaatccaacactgtgtgagcgcccacatgatattcaaaggaaatgtttattgaaacatttcaaattataggtttttggattagggatgctaaaccagtaagtatacagctgaattccaatatacaaaaatatctgaaatttgaaatacttctggtagcatgcattttggataagggataatcaagccatatacagaaaatactgaagtaatgcctttcttctggtcagtgcagagcacgttgctcttctcccaaagtttttcatttagaccccttttgagattcatctgatattggcctagaagtggccgtaagactacaaaccctcacttttggatgtttctctccttcacctcagcagggtatatttaaacatagcatgtggtctttccttttaaaattgtgtatgttcccattggtggtataactttataacttgcatgtctttaacaaaattctttcctatgtttttttttttaattatttctttttctcataggaagtgaagagatccttctgtaaaggtttttggaattatgtctgctgaataataaacttttttgaaataataaatctggtagaaaaatgaaaa

SEQ ID NO: 312035 - DNA, 1878 bp, Homo sapiens
agtttcagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacactatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcgggagtgtgggaaggttgaggaaagggtactgaaagtccatttgagtcaagaactctaggtttacaggctgagaatccttaatccaaaaatttgaattttgaaatgctctaaaatccaacactgtgtgagcgcccacatgatattcaaaggaaatgtttattgaaacatttcaaattataggtttttggattagggatgctaaaccagtaagtatacagctgaattccaatatacaaaaatatctgaaatttgaaatacttctggtagcatgcattttggataagggataatcaagccatatacagaaaatactgaagtaatgcctttcttctggtcagtgcagagcacgttgctcttctcccaaagtttttcatttagaccccttttgagattcatctgatattggcctagaagtggccgtaagactacaaaccctcacttttggatgtttctctccttcacctcagcagggtatatttaaacatagcatgtggtctttccttttaaaattgtgtatgttcccattggtggtataactttataacttgcatgtctttaacaaaattctttcctatgtttttttttttaattatttctttttctcataggaagtgaagagatccttctgtaaaggtttttggaattatgtctgctgaataataaacttttttgaaataataaatctggtagaaaaatgaaaa

SEQ ID NO: 312036 - DNA, 1977 bp, Homo sapiens
ggggtatataagagctggattactagttagcaaatgagggggtaaatattccagtggatacaagcttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactaaaaatacaaaaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaactctttgctgtataagaattatttcttttgtttaacaaattagacatttctggcagaggttatgtatatgatacactttttttgatagcagctgcaatgttggacagaagatgaaatgctttgctttgagtcagattcttatgaatatctgcttttccctgactttgagttaggtagctttggaagtagcattaattcagataaactgccatcatgctgcgttatgccatttctaaagacactcaacttgtacttttaaaaaaatagaaaaaataagcatttcaatctaagtggaaatttgactcattgacttacatttctaagttaaaatttccctttatgaagtgtgccttaggttaccaaattgtagaggctttcgttggtggtggtaagtggtagcggtagtgagtgtatagaggcagggaaatatatttataataaattctatgtcatgaattacatattgaaataaataggtgaatatacaaatttata

SEQ ID NO: 312037 - DNA, 1895 bp, Homo sapiens
aagctttgcacatctccaggtcagacctatcctaatatctacatctacatttccagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactaaaaatacaaaaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaactctttgctgtataagaattatttcttttgtttaacaaattagacatttctggcagaggttatgtatatgatacactttttttgatagcagctgcaatgttggacagaagatgaaatgctttgctttgagtcagattcttatgaatatctgcttttccctgactttgagttaggtagctttggaagtagcattaattcagataaactgccatcatgctgcgttatgccatttctaaagacactcaacttgtacttttaaaaaaatagaaaaaataagcatttcaatctaagtggaaatttgactcattgacttacatttctaagttaaaatttccctttatgaagtgtgccttaggttaccaaattgtagaggctttcgttggtggtggtaagtggtagcggtagtgagtgtatagaggcagggaaatatatttataataaattctatgtcatgaattacatattgaaataaataggtgaatatacaaatttata

SEQ ID NO: 312038 - DNA, 2069 bp, Homo sapiens
ggggtatataagagctggattactagttagcaaatgagggggtaaatattccagtggatacaagcttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagacaggaatggataattccagttttgtcaagaaatatactcttggaacttagaggggcaaagccagaacatgaagcgggaaaaaaatcaaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacagctaataatgaagttattcttgacatgagaaaatcagtaattggaccaggcgcggtggctcttgcctgtaatcccagcactttgggaggccgaggcaggcagatcacaaggtcaggagttcgagaccagcctgaccaacatggtgaaaccctgtctctactaaaaatacaaaaattagccgggggtggtgacatgtgcctgtaatcccagctactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaactctttgctgtataagaattatttcttttgtttaacaaattagacatttctggcagaggttatgtatatgatacactttttttgatagcagctgcaatgttggacagaagatgaaatgctttgctttgagtcagattcttatgaatatctgcttttccctgactttgagttaggtagctttggaagtagcattaattcagataaactgccatcatgctgcgttatgccatttctaaagacactcaacttgtacttttaaaaaaatagaaaaaataagcatttcaatctaagtggaaatttgactcattgacttacatttctaagttaaaatttccctttatgaagtgtgccttaggttaccaaattgtagaggctttcgttggtggtggtaagtggtagcggtagtgagtgtatagaggcagggaaatatatttataataaattctatgtcatgaattacatattgaaataaataggtgaatatacaaatttata

SEQ ID NO: 312039 - DNA, 1767 bp, Homo sapiens
ggggtatataagagctggattactagttagcaaatgagggggtaaatattccagtggatacaagcttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatgaaatgtttttgctatagatttgtattttaaaacataagaacgtcattttgggacctatatctcagtggcacaggtttaagaacgaaggagaaaaaggtagtttgaaccttggtaaattgtaaacactactcaggaggctaaggcaggagaatcgcttaaacccaggaggcggaggttgcagtgagccgagattgcaccactgcactccagcctgggtggcagagtgagactcgtctcaaaaaaaagaaagaaaattagtaattgtaagtacccctgataagcaaattagtaattgtcaatacccctgttaagcaattcctttttgcagtatatttctgaaatgacagaatgctgttttaaaaacaaagaaataaaatcctgctcctgactcggtcaaaatattttttaaagtctattgtttgttgtgcttgctggtactaagaggctatttaaaagtataaaactgctttgtatccatgagggtttcattgtgtgttagcagcagtgagcttctattaaatgtatatgtcatttattttgtttaagtggctttcagcaaacctcagtcatattcttatgcagggtattgcgaaacaacttgtgttctattaatcgtgtcttcaattaaaagaccacagacttctggaaactctttgctgtataagaattatttcttttgtttaacaaattagacatttctggcagaggttatgtatatgatacactttttttgatagcagctgcaatgttggacagaagatgaaatgctttgctttgagtcagattcttatgaatatctgcttttccctgactttgagttaggtagctttggaagtagcattaattcagataaactgccatcatgctgcgttatgccatttctaaagacactcaacttgtacttttaaaaaaatagaaaaaataagcatttcaatctaagtggaaatttgactcattgacttacatttctaagttaaaatttccctttatgaagtgtgccttaggttaccaaattgtagaggctttcgttggtggtggtaagtggtagcggtagtgagtgtatagaggcagggaaatatatttataataaattctatgtcatgaattacatattgaaataaataggtgaatatacaaatttata

SEQ ID NO: 312040 - DNA, 623 bp, Homo sapiens
ggggtatataagagctggattactagttagcaaatgagggggtaaatattccagtggatacaagcttggactcttttcttgaagctttctttctatcagaagcatttgctgatattgctgacattgaaacattaaaagaaaatttgagaagcaatgggcatcctgaagctgcaagtatttctcattgtgctctctgttgcattgaaccatctgaaagctacacccattgaaagtcatcaggtggaaaagcggaaatgcaacactgccacatgtgcaacgcagcgcctggcaaattttttagttcattccagcaacaactttggtgccattctctcatctaccaacgtgggatccaatacatatggcaagaggaatgcagtagaggttttaaagagagagccactgaattacttgcccctttagaggacaatgtaactctatagttattgttttatgttctagtgatttcctgtataatttaacagtgcccttttcatctccagtgtgaatatatggtctgtgtgtctgatgtttgttgctaggacatataccttctcaaaagattgttttatatgtagtactaactaaggtcccataataaaaagatagtatcttttaaaatg

SEQ ID NO: 312041 - DNA, 1119 bp, Homo sapiens
  misc_feature (1119)..(1119): n is a, c, g, or t
gttttattcattcttgaatttttcctttctaaagagctcttctatttatacatgcctaaattcttttaaaatgtagagggatacctgtctgcataataaagctgatcatgtttttcacctgcaaactgtagcaaaacctctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaacttcgaaacaaaaaaggggggggtttaaattcctggaggggccagtaggtaccagttttgaaagggccaagggaggaaaagaagggtcgggtaaaggggaggaacggatggttggagactttggggtgaaggacacaggtcgcggttatgtgaggaggtcgtgatgtggtaaagagaaaagaaagaagaagaggacagcggtcacaggtctcgcn

SEQ ID NO: 312042 - DNA, 396 bp, Homo sapiens
ggggtggtgccagtgccagcatccctctgttctaagacattgtcccttctcttgcagctgtcatagtctcagcccgcatggcccccgaggagatcatcatggacagacccttcctctttgtggtccggcacaaccccacaggtgagcctggaacccatcaccgttccacatcctcccacccattctttctctcaggaactagtcccgacagatgcagacatccctctatccctgagagggctctgggcagggaacccataaccctaccctgcttcctgtcccaagaggaggctaccttctatcacccacagacagtgccgggtccccgctctgtgactcaggcagctgcgactccagacagctcactcatctgcctagatctcagtccttccaccc

SEQ ID NO: 312043 - DNA, 325 bp, Homo sapiens
  misc_feature (15)..(15): n is a, c, g, or t
ttttgggggatggantcctagctcagtcatccccaggtggaggttgcagtgagccgaacgaaattgagccacttcaccccagcctgggcaaaagagtgaaattcccattcaaaaaaaaaaaaaaaaaaaaaggatgaggactgggatgaactggtggctgggtgtggggaaaatggaagtgaaggaaggccaaaagagacagagaaggcctggcgcggcgactcacgcctataatcccagcactttgggaggctgagaagggggattgcttgaggccagaagttgaataccagtctgggcagcatagcaagccctgcctctacaa

SEQ ID NO: 312044 - DNA, 299 bp, Homo sapiens
ccttcaccagccctctttccattgctctaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaaggatcacccaaggctaggagttcaaggccagcctgggcaatacgg

SEQ ID NO: 312045 - DNA, 3192 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312046 - DNA, 3840 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccatggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaaaaaaaaaaaaaaaaaaaaaaaaaaaaaaaaaaaaaaaaaaaaaaaaaaaaaaaaaaaaaaaaaaacaaaacaaaaaaaaaaaaaaaaaaaaaaaaaaacgagcacagagaggacaaacgacaaaaaacaaaacacaacaacaaaacgggggggggcggggggccgcgcgaggaaacccggggggcggcgacccagacaggatagaaaaaagtaaagagaggcgagggtctgatcaacacaacaaaaaaacaaggcagaggccgagaacaagcgggtagtcgaccaacacaacaaataagaaggagcgcaggcgcgatcagaggtatatatagaaaaacacgatagctagcgggggagcaactcgatctcaacatacgttgcaacagcaagggcgacggagcgaagttaataaaataaagctccaccgcgcgtgataagacacaacgggagcgaagaccgacggcgacgagaaacgaacgagaacgggcgagagaagaagggtcgagcctgggacgcgcaagactgacgaatgagcgagacgacgggacgcaccgcgagagagcgaaaggacacgagaaacagcggaaggtacaggcaggagcacagcgaaagacagaagcgacacaagcggaagagagagaggacatgaaaggacagagagagaagacgggtgacgaagcagacgcagaagagagacagaaagaaaaccaaaaatgggcgt

SEQ ID NO: 312047 - DNA, 2799 bp, Homo sapiens
cggacgcgtgggcgaccacgcgtcgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312048 - DNA, 3139 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaagcgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312049 - DNA, 2646 bp, Homo sapiens
tcagtcggtacacaagctgactcttccacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312050 - DNA, 3110 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccaaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312051 - DNA, 2441 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgcctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312052 - DNA, 1884 bp, Homo sapiens
gttttattcattcttgaatttttcctttctaaagagctcttctatttatacatgcctaaattcttttaaaatgtagagggatacctgtctgcataataaagctgatcatgtttttcacctgcaaactgtagcaaaacctctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312053 - DNA, 2534 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312054 - DNA, 2888 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactaaaaaaaaaaaaaaaaaacaaaacaaaaaaaaaaaaaaaaaaaaaaaaaaacgagcacagagaggacaaacgacaaaaaacaaaacacaacaacaaaacgggggggggcggggggccgcgcgaggaaacccggggggcggcgacccagacaggatagaaaaaagtaaagagaggcgagggtctgatcaacacaacaaaaaaacaaggcagaggccgagaacaagcgggtagtcgaccaacacaacaaataagaaggagcgcaggcgcgatcagaggtatatatagaaaaacacgatagctagcgggggagcaactcgatctcaacatacgttgcaacagcaagggcgacggagcgaagttaataaaataaagctccaccgcgcgtgataagacacaacgggagcgaagaccgacggcgacgagaaacgaacgagaacgggcgagagaagaagggtcgagcctgggacgcgcaagactgacgaatgagcgagacgacgggacgcaccgcgagagagcgaaaggacacgagaaacagcggaaggtacaggcaggagcacagcgaaagacagaagcgacacaagcggaagagagagaggacatgaaaggacagagagagaagacgggtgacgaagcagacgcagaagagagacagaaagaaaaccaaaaatgggcgt

SEQ ID NO: 312055 - DNA, 1427 bp, Homo sapiens
tcgacccacgcgtcggcctgccaccgcggaggcaggcagtacaagagtgatggcaatgtgactggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312056 - DNA, 1573 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggtgagcctggaacccatcaccgttccacatcctcccacccattctttctctcaggaactagtcccgacagatgcagacatccctctatccctgagagggctctgggcagggaacccataaccctaccctgcttcctgtcccaagaggaggctaccttctatcacccacagacagtgccgggtccccgctctgtgactcaggcagctgcgactccagacagctcactcatctgcctagatctcagtccttccaccc

SEQ ID NO: 312057 - DNA, 1296 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagccccattgccccagaggtatttctgcacgatgggatcctctagaaca

SEQ ID NO: 312058 - DNA, 1528 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacaggtgagtctggctcaggtgaggctccacgggtgtcgcctccatcgcccttcaggataactggtccccagacccggaaaggaccccgcagccctctcggcacagagcagctctgtctgtgctcagccatcacccactccccacctgtttctcagcctggaaaacgggcttgggaccatggaaccctgtttcctcgcctgatggctcctaagttccctgactgtgaaaaggcctcctaaagaaaaacccaagttgttcccacagtgggaagtaaacttaagaaacatgcttatcagg

SEQ ID NO: 312059 - DNA, 1361 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagtaagccaccccgctatctccccgacctaccaacccctctctcctggctccctaaagtcaccgcccccaggttgaatttcccagatctgtgatgcttgcaggacatgcatgtgtgggaggctgatgggaaactgtggcctgggtttgattatgagtcttgcaatcatccctccccctgtttctgctggagggcaggggacagctcttcctgaccacacccccacattgactatccccagaatacccagcaaaagcccccttagggtcgccccatcagcacttccatccccaaccctttcaagtcaacatccaaac

SEQ ID NO: 312060 - DNA, 1718 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatagtaagtccaagagccccttccccacagcccacagcaactgcatctcattcctggggtctcccaaggaatacccaaaatgtcaccctctgagggaggaagaccacagggaatgctcccctttaagggaggagagaccctagaatatactccagctttgacaaagatttcccaagcaggagacatcaggataatgggaacagaagacaggaggtttatcccatgaaggatgaagaagctgaaatccagagattccctcagggccacatttgtccacctgactccagggtctcatcttcgtgtgttgctagtgtgattacctggggatgagaaatcctgctgggggagttgaggttaagaggatgaggactccaggtgctgtggctcacgcctgtaatcccagcactttgggaggccaaggcaggtggatcaggagtttgaggtcaggagtttgagaccagcctggccaacatggtgaaaccctgtctctactaaaaatgcaaaaattagccaggtgtggtggcaggcgcctgtaatcccagctactcgggaggctgaggcaggagaatcacttgagcccgggaggtggaggttgcagtgagccgaacgaaattgagccacttcaccccagcctgggcaaaagagtgaaattcccattcaaaaaaaaaaaaaaaaaaaaaggatgaggactgggatgaactggtggctgggtgtggggaaaatggaagtgaaggaaggccaaaagagacagagaaggcctggcgcggcgactcacgcctataatcccagcactttgggaggctgagaagggggattgcttgaggccagaagttgaataccagtctgggcagcatagcaagccctgcctctacaa

SEQ ID NO: 312061 - DNA, 519 bp, Homo sapiens
agccatacctgaaagtattatagagagtgtgtgtatgtgtgtctgtgtgtgtgtgtgtgtctgtgtgtgtgttagagagagagagagtgccccttatgaaaaagaggtgcctctctctgccctcaccaacattctgagtgcccagctcatcagccactggaaaggcaacatgaccaggctgccccgcctcctggttctgcccaagtaagccaccccgctatctccccgacctaccaacccctctctcctggctccctaaagtcaccgcccccaggttgaatttcccagatctgtgatgcttgcaggacatgcatgtgtgggaggctgatgggaaactgtggcctgggtttgattatgagtcttgcaatcatccctccccctgtttctgctggagggcaggggacagctcttcctgaccacacccccacattgactatccccagaatacccagcaaaagcccccttagggtcgccccatcagcacttccatccccaaccctttcaagtcaacatccaaac

SEQ ID NO: 312062 - DNA, 229 bp, Homo sapiens
ggtttgattatgagtcttgcaatcatccctccccctgtttctgctggagggcaggggacagctcttcctgaccacacccccacattgactatccccagaatacccagcaaaagcccccaaaaggagagtcagagaaatgagggaggtgggggcccaatcagtccacatctacttagggtcgccccatcagcacttccatccccaaccctttcaagtcaacatccaaaca

SEQ ID NO: 312063 - DNA, 221 bp, Homo sapiens
gttctccctggagactgaagtcgacctcaggaagcccctagagaacctgggaatgaccgacatgttcagacagtttcaggctgacttcacgagtctttcaggtaagaagactttcctttgcattttctcaccccagtggactgcgggggcccctaagaggaaaaaggaacctctccttgagagcggcagctgatctaatcctgtatccacatctgtttcag

SEQ ID NO: 312064 - DNA, 489 bp, Homo sapiens
tggttcttccaccctcaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatca

SEQ ID NO: 312065 - DNA, 858 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggtaggagaaaagcaaactccctccaacctcttacttcgggcttaaggcagagaactcgcctccccagaatctcctccctccatgatcccccgctattcctctattttcttttcctcggacctgcagccttgggtcgaccctgccctaggggtgactgcaggagagcagggaggatggtcaggcgtcaccaacaaccccatcacccagtaacaagaaccttgactctctcagtccctctgcatcaagacacttacccatttcccacctcatgcctgctaacttgaatgaaacaatcgctgggaaagcattaagagaattaaggctgggcactgtggctcatgcctgtaatcccagcactttgtgaggctgaggcaggcagataacttgagcccaggagtttgagaccagcctgggcaacatggcaaaaccctgctctcccaaaaaaatacaaaaattagctgggcgtgctggtgtgcctgtattcccagctacttgggaggctgaggtgggaggattgcttcagctggggaggcggaggctgcagggagccaagactgagccattgcacccagcctgggtgacagagcaagaccctgtctctaaaaatgaatgaaaggaaggaagaaagagagagaaagagagagaggaaagaaggaaggaagtaaagaagaaagaaagaaagaaagaggaaagaggaagaaagaaagaaaag

SEQ ID NO: 312066 - DNA, 745 bp, Homo sapiens
gaacagagaaaaatattctagcccaaagaaagggttgggatctgagacttttgaagaaaggaaggagatacagaaaagagatttcatcctggaatgaaatctccctccagagagccctgggaaagcacggtagcccccatccatcagagtggagccccttgtgggggaagtgggctcggctgggaaccctcaattcagcataagcctcacatgtcctctcctctctgtcccggtgcagacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtgagcaggcagggaaaggaaacccatttcctgggcctcaagagaaagggaatttggaaataaatccacatatcccagttgggtgcagtagttcacacctgtaatcccagcccaacactttgggaggtctaggcgagaggaaggcttgaggcctggagtttgagaccagcctggccaacataacaagacctcatctcttcaaaaaatttaaaaaccagccgggcatggtggtgcacacctgtagtcccagctacttgggaggctgaggtggga

SEQ ID NO: 312067 - DNA, 3157 bp, Homo sapiens
tcctgctgcattcctcctgctgcttcctcctgctgctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312068 - DNA, 3139 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312069 - DNA, 2802 bp, Homo sapiens
tacatatacgacttgagttagtacctgaacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312070 - DNA, 2611 bp, Homo sapiens
caaaacaacaacaacaacaacaacaaaatcgtctaacttcctgatcttcctgatcattgattttcccataggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312071 - DNA, 2545 bp, Homo sapiens
caaaacaacaacaacaacaacaacaaaatcgtctaacttcctgatcttcctgatcattgattttcccataggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgcccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312072 - DNA, 1793 bp, Homo sapiens
gcagaagagaagggaaatagaaattaaaatactgaataggggagcagtgaacaggggatacccaaaagccaagagcgagagagagcctggcttccagaaatagtggagaagccaggagaactaggtgaaaacccagtgctgggttgccatcagcgagagctggagccatttccaacgaaccatcttgtcgtcttcacagctgagttcaccacgcccgatggccattactacgacatcctggaactgccctaccacggggacaccctcagcatgttcattgcctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtcactg

SEQ ID NO: 312073 - DNA, 2427 bp, Homo sapiens
  misc_feature (2427)..(2427): n is a, c, g, or t
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaaggtcagatgcgtgcccagctcttcaccccccaatctcttggtggggaggggtgtacctaaatatttatcatatccttgcccttgagtgcttgttagagagaaagagaactactaaggaaaataatattatttaaacttcgaaacaaaaaaggggggggtttaaattcctggaggggccagtaggtaccagttttgaaagggccaagggaggaaaagaagggtcgggtaaaggggaggaacggatggttggagactttggggtgaaggacacaggtcgcggttatgtgaggaggtcgtgatgtggtaaagagaaaagaaagaagaagaggacagcggtcacaggtctcgcn

SEQ ID NO: 312074 - DNA, 1371 bp, Homo sapiens
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggacccacgcgggatcttagatcga

SEQ ID NO: 312075 - DNA, 1884 bp, Homo sapiens
  misc_feature (1852)..(1852): n is a, c, g, or t
ggggcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatagtaagtccaagagccccttccccacagcccacagcaactgcatctcattcctggggtctcccaaggaatacccaaaatgtcaccctctgagggaggaagaccacagggaatgctcccctttaagggaggagagaccctagaatatactccagctttgacaaagatttcccaagcaggagacatcaggataatgggaacagaagacaggaggtttatcccatgaaggatgaagaagctgaaatccagagattccctcagggccacatttgtccacctgactccagggtctcatcttcgtgtgttgctagtgtgattacctggggatgagaaatcctgctgggggagttgaggttaagaggatgaggactccaggtgctgtggctcacgcctgtaatcccagcactttgggaggccaaggcaggtggatcaggagtttgaggtcaggagtttgagaccagcctggccaacatggtgaaaccctgtctctactaaaaatgcaaaaattagccaggtgtggtggcaggcgcctgtaatcccagctactcgggaggctgaggcaggagaatcacttgagcccgggaggtggaggttgcagtgagccgaacgaaattgagccacttcaccccagcctgggcaaaagagtgaaattccctgcagctcagcagccgccgccagagcaggacgaaccgccaatcgcaaggaacctctgagaacttcaggtaggagaaaaagcaaactccctccaacctcttacttcgggcttaaggcagagaactcgcctcccagaatcttctccctccatgatccccgctattctctatttctttcctcggacctgcagcctggggtcgaccctgccctaggggtgaatggcaggagagcaggaaggatggtccggcgttaccgaaaagcccattaaaccagttaacaagaaccctggaatcctcttcagtccccctgggatcaggaaatttacccattttccaccctcaaggccggttactngaatggacaatccctgggaaagccttagagga

SEQ ID NO: 312076 - DNA, 390 bp, Homo sapiens
tgaaagtgttggtatcccttgtttgaggctgtgttgaacttgtgtttgatatctggtctgtatcttggattcttctcctcctctcttcctctttatacgctctcataacctatgaataggattgctggaagatcagggaagtgaagttcaatggaaatgactttggattttatcctaagggcagtgggataccactgaagggtgtcatgagaggagtgacataatcagatttggagctctgaaggatcatttgactgctgcacacagcacgggctgcagggaagcaacagcaagagagaccaactctgggcaactccagccacggtcccagcagggactgatgatgcctggactagaatgatgatgaaggaaagagggggagcagacaga

SEQ ID NO: 312077 - DNA, 887 bp, Homo sapiens
  misc_feature (1)..(3): n is a, c, g, or t
nnnggagacagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaattttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgt

SEQ ID NO: 312078 - DNA, 412 bp, Homo sapiens
gtctgtgcttctctatcggagagttgggtgagaactagctctctctgttcagctaatctgctttctttgcttctcttgtagcctcttcagaagaaacttgactccttcccagctcaggacccttgcaccaccatatatgttgctgccacagagcctgtcccagagtctgtccaggtgaggcatctctctgcctactctccgtagagagggaatacatgaaggaggggaaaatgaggaagttttttttttttaaggtgggaagagggagaggatcagggaaaatagctattgggcactaggcttcatacctaggtgacaaaatactgtgtataacaaatcctcatgacacaagtttacctatgtaacaaaccagcacatgtacgcctgaacttaaaataaaagtaaaaaaaaa

SEQ ID NO: 312079 - DNA, 2017 bp, Homo sapiens
  misc_feature (1)..(3): n is a, c, g, or t
nnnggagacagctaaggaaagaagctggggcgcatgtttctgcccaaagccgggttttggccgaggtgactacacaccccctttcctggctcccataggctaagtgcctggcttcttgagaagcctgcttcttgagaacaaaaaagtgatttaaagcctcatgggagatgagcaatcctcaagacacaagcagaaaaagtcccagtgatacaggaagcgggttcaggaacctgctggttcctgatacataaatcagacagcctctgctgcatgacacgaagcttgcttctgcctggcatctgtgagcagctgccaggctccggccaggatcccttccttctcctcattggctgatggatcccaaggggctcctctccttgaccttcgtgctgtttctctccctggcttttggggcaagctacggaacaggtgggcgcatgatgaactgcccaaagattctccggcagttgggaagcaaagtgctgctgcccctgacatatgaaaggataaataagagcatgaacaaaagcatccacattgtcgtcacaatggcaaaatcactggagaacagtgtcgagaacaaaatagtgtctcttgatccatccgaagcaggccctccacgttatctaggagatcgctacaagttttatctggagaatctcaccctggggatacgggaaagcaggaaggaggatgagggatggtaccttatgaccctggagaaaaatgtttcagttcagcgcttttgcctgcagttgaggctttatgagcaggtctccactccagaaattaaagttttaaacaagacccaggagaacgggacctgcaccttgatactgggctgcacagtggagaagggggaccatgtggcttacagctggagtgaaaaggcgggcacccacccactgaacccagccaacagctcccacctcctgtccctcaccctcggcccccagcatgctgacaatatctacatctgcaccgtgagcaaccctatcagcaacaattcccagaccttcagcccgtggcccggatgcaggacagacccctcagaaacaaaaccatgggcagtgtatgctgggctgttagggggtgtcatcatgattctcatcatggtggtaatactacagttgagaagaagaggtaaaacgaaccattaccagacaacagtggaaaaaaaaagccttacgatctatgcccaagtccagaaaccaggtcctcttcagaagaaacttgactccttcccagctcaggacccttgcaccaccatatatgttgctgccacagagcctgtcccagagtctgtccaggaaacaaattccatcacagtctatgctagtgtgacacttccagagagctgacaccagagaccaacaaagggactttctgaaggaaaatggaaaaaccaaaatgaacactgaacttggccacaggccccaagtttcctctggcagacatgctgcacgtctgtacccttctcagatcaactccctggtgatgtttcttccacatacatctgtgaaatgaacaaggaagtgaggcttcccaagaatttagcttgctgtgcagtggctgcaggcgcagaacagagcgttacttgataacagcgttccatctttgtgttgtagcagatgaaatggacagtaatgtgagttcagactttgggcatcttgctcttggctggaactggataataaaaatcagactgaaagccaggacatctgagtacctatctcacacactggaccaccagtcacaaagtctggaaaagtttacattttggctatctttactttgttctgggagctgatcatgataacctgcagacctgatcaagcctctgtgcctcagtttctctctcaggataaagagtgaatagaggctgaagggtgaatttcttattatacataaaacactctgatattattgtataaaggaagctaagaatattattttatttgcaaaacccagaagctaaaaagtcaataaacagaaagaatgattttgaaaaaaaaaa

SEQ ID NO: 312080 - DNA, 1059 bp, Homo sapiens
gaaacctctgttttcttagatttgagcagggtggtcacactgaccttgcagagttctgagaatcagagacagaacataaaaggcctggaaaacattctccaaaaagaagctgcaacatgtgtggacaatgggcttttcatgcctctcttactgtctcttactgtctattgacctggtgcaagaaacatgctctggtgatggctgtgagggaggaatgaggatagacatagacactcctgtgtctcaaacatgcttctttattactctgttatgactctgtcttccctggggcaggaccccagcctgcctacatttgcagacagacacagtggcatgtggagacaacagtgtgtcccaatgacttttctttaccccctagctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312081 - DNA, 500 bp, Homo sapiens
tgaaagtgattgtaatccatagggaaatgtttcaacgtgcgcaagcgttgcggcggcgggcagaggactactacagatgcaaaatcaccccttctgcaagaaagcctctttgcaaccgggtaagtttgcttgttttccttgcttttggacatagtctgccaggtcaggacatggatacatttttctccctacggctctgtgctcaagccctgcagagggagatggcagagaggaaggctgcctacaagcatcacagtcccatccctgttggtaactgtgttgcgcaaaaacaccttcatccccacccagtggggcccccatctaatattctaagtgtcagaggttccgtatttgtaatagcaaatgggccctgactgtaaattagtgaagagtgaatgtaacttattacccacagggacaattccaaatgagggccttaaatgatgctcagctaagctggttcttgtgtggcctctgtaccttcaaaagctgccgagtcc

SEQ ID NO: 312082 - DNA, 3234 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312083 - DNA, 3240 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312084 - DNA, 1387 bp, Homo sapiens
cagccccgtaccacacggcgttggcgcccaggaagagacagatgaggagaacgcagcaggtggccctctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgagcaggcctttgctggacagatgaagagtgacttgtttctggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312085 - DNA, 3415 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312086 - DNA, 3126 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacaggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312087 - DNA, 3869 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaaaaaaaataaaacataaaataaataaagaaaaaacaaaaagaaaccaagaaaacacaaaaaacaacaaataagaacagaaccaaccacacgcggaatgacagacacatacacagcaagaacacgatacaagaatcacacacataaacagcacaaagaaacgcgcggcgcggccgacaccagaagaccaaacacccgacgaggggcggggccgccgctaacaagctacgcagcagagcatgtacacaaggagaagacggagggccgacagcacgccagagaacgaggaccgccacacaaaacaccaccagaccgaagcgggccggagacgacggctcgggccctcaagaagagcacgcgggggcgcgaagccagaaacaacaagcagaaggaggcggcgacgaaactacgacggcagggcagcacaacacccaactcctacgatggagaggggacgtcagagaaaagagagactgaagagaggaaaacagacgcggaggcaaag

SEQ ID NO: 312088 - DNA, 3439 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttaaaaaaa

SEQ ID NO: 312089 - DNA, 3294 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacactgagtgtgtctgctcactccccttccaccctcagcggatgataatctcaagaaactaaggaagaataaataaataatataaaaataaaa

SEQ ID NO: 312090 - DNA, 3358 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312091 - DNA, 3280 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggctgtcggcagtactcagtggaagggtgatattatgacactgacactgctattttgaaacctggaggatggaaaggtgcaaaaatctatcaccagcaacagaaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312092 - DNA, 3047 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312093 - DNA, 3174 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgtgagtgtgtctgctcactccccttccaccctcagcggatgataatctcaagaaactaaggaagaataaataaataatataaaaataaaa

SEQ ID NO: 312094 - DNA, 3286 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctctccaccctcagcggatgataatctcaagacacctcctgagtgtgtctgctcactccccttccaccctcagcggatgataatctcaagaaactaaggaagaataaataaataatataaaaataaaa

SEQ ID NO: 312095 - DNA, 564 bp, Homo sapiens
atgcattctgggggtggcaggatgagtggtgcgaccaagtctccttttgaccctcctgagtgtccaggccgattgtctcttcttccctcagctgcagctcccacacctctgctgggaggctgtccgattcacacaccccctcagcgggggggcttgttcctctgtctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312096 - DNA, 2351 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaaca

SEQ ID NO: 312097 - DNA, 2324 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggtgggttccctagagaaacctcgagccctggtgcaggtcactgtgtctggagtgccgggggtgtgcgggctgcgtgtccttgctgggtgtctgtggctccatgtggtcacaccacctgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacgacccccacttactgggtctctccttttacaaccaacacaaccgaaatctagggcttcttcttttttttttttttttttgagacagagtctcattccagcctgggtgacagagtgagaccccatctcaaaaac

SEQ ID NO: 312098 - DNA, 1988 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtgggctggggctggggacccgggagtactgggaatggagcctgggcctcggcaccatgcccagggccgccactttccagtgctgcagccagagggaaaggcgtccaccaaaggctgctcgggaagggtcaacacacttgagcagccttagctagactgaccagggagaaagagagaagactcagaagccagaatcgtgaaagaacgagggcacttcgctaagcagacgccacggacaactgcacagcagcacgccagataactcagaagaagcaagcacgcggctgtgcacgcttccgaaattgcactccagcctgggcgactgagtggagcggaactctgtctca

SEQ ID NO: 312099 - DNA, 1166 bp, Homo sapiens
cacgacggctgcggccgctggggttggagctattcgatggagttgagtgtttggtggagtccgaatcaggctctttgtcaaagtcctggtctggatcagacatacttctcagaggcacagtcacgctaggctccgatccacctgatgagggccacgagatgtagggcttgttcctggatggaggctggcgagccaggttggtgggagcggggcctggtggagaaggaggtgctgccgcgagtcacgcagccctgttgcgcttccggcgcctgctggtggctgagctgcagcgtggcttctttgacaagcacatctggctctccatatgggaccggccacctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttccggatgtcccggagcaaggtggctgggagcctgagccccacacctgccgggcagtaggtgctggacatcgacagctgcctggactcgtccgtgctggacagctccttcctcacgttctcaggcctccacgctgagcaggcctttgctggacaggtgaagagtgacttgtttctggatgattctaagagtgaccttgaggaaccctgggagctcaggaaggaaggagcgcccagaagcagggacagggagctggttggggaggaccagaaatcagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattc

SEQ ID NO: 312100 - DNA, 487 bp, Homo sapiens
caccacctgggagcaggtttgctcggaagcccagggtgtccgtgcgtgactggacgggggtgggctgtgtgtgtgacacatcccctggtaccttgctgacccgcgccacctgcagtctggtgtgctggccctccagcgagggaacgcccagttggccggacctgctcagtgacccgtccattgtgggtagcaatctgcggcacgacccccacttactgggtctctccttttacaaccaacacaaccgaaatctagggcttcttcttttttttttttttttttgagacagagtctcattccattctgtcacccaggctggagtgcaatggtacgatctcggctcactgcaacctccgcctcccaggttcaagggattgtcctgcctcagcctcctgagtagctgggattacaggcgtgtgccaccatgcctggctaatttttgtatttttggtagagacggggtttcagcatgttggtgaggctggtc

SEQ ID NO: 312101 - DNA, 442 bp, Homo sapiens
ggagaaagagagaagactcagaagccagaatcgtgaaagaacgagggcacttcgctaagcagacgccacggacaactgcacagcagcacgccagataactcagaagaagcaagcacgcggctgtgcacgcttccgaaatgcactccagaagaaaatctcagtacatctatagcaagtgaagaggccgagttagtcccttagaaacctcccagtggccgggccgggtgtggtggctcacgcctgtaatcccaacacttcaggaggccgaggtgggcggatctgagtccaggagtttgagaccagcctgggcaacatagcaagaccccatctatataaaacattaaaaagggccaggcacggtggctcacgcctgtaatcccaacactttgggaggccgaggcgggcagatcagttgaggtcaggagttcgagaccagcctggc

SEQ ID NO: 312102 - DNA, 3367 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312103 - DNA, 2957 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312104 - DNA, 3043 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312105 - DNA, 3391 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttaaaaaaa

SEQ ID NO: 312106 - DNA, 3304 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggtgcacttacaatttggtattacctgggagtgaaaagaaatattacagccatgcctaactgacttcttgaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312107 - DNA, 3065 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaa

SEQ ID NO: 312108 - DNA, 3196 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctcagctctaccctcagcggatgataatctcaagacacctgccgagtgcctgctctatgtcattttcagggatcctctagaacacc

SEQ ID NO: 312109 - DNA, 3499 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtgtgctctatccccttccaccctcagcggatgataatctcaagacacctcccgagtgtctgctcactccccttccaccctccccgcctaattttttgtatttttagtagagacggggtttcaccgtattagccaggatggtctcaatctcctgacctcgtgatccatccgcctcgccctcccagagtgctgggattacaggcgtcagccaccgtgaccggctcagactgtactcttctagccatctgaaatacgttttctaggtagagatagattgtgtaagggtacagttgtgaggataacagaaacatggcagattatttaaaatcatcctgaaagtggtgctttatctgatgaaagtgattgtaatccatagggaaatgtttcaacgtgcgcaagcgttgcggcggcgggcagaggactactacagatgcaaagtaaggagcttcctccccgcagttgcaggat

SEQ ID NO: 312110 - DNA, 3382 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccggctgtcggcagtactcagtggaagggtgatattatgacactgacactgctattttgaaacctggaggatggaaaggtgcaaaaatctatcaccagcaacagaaggtgcagactgtgttggtggcggtaattttgtccatcaaatgaatatgtgtgaaaacattccctcctttggccctacaggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaatgaatactgcagtccttaaaaaaa

SEQ ID NO: 312111 - DNA, 3443 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcagtagagactgggtttcaccgtgttcgccaggatagtctccatgtcttgacctcgtgatctgcctgcctcggcctcccagtgctgggattacaggcgtgagccaccgcgcctggccaaaatatataaccttaagtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccgtctcaaaatggacatgatggatccacggatgtacagcagagagccaggaggtccaactgccgtagacaggaaggaattaaaattgtcctggaagacatctttactttatggagacaggtggaaaccaaagttcgagctaaaatccgtaagatgaaggtgacaacaaaagtcaaccgtcatgacaaaatcaatggaaagaggaagaccgccaaagaacatctgaggaaactaagcatgaaagaacgtgagcacggagaaaaggagaggcaggtgtcagaggcagaggaaaatgggaaattggatatgaaagaaatacacacctacatggaaatgtttcaacgtgcgcaagcgttgcggcggcgggcagaggactactacagatgcaaaatcaccccttctgcaagaaagcctctttgcaaccgggtcagaatggcggcagtggagcatcgtcattcttcaggattgccctactggccctacctcacagctgaaactttaaaaaacaggatgggccaccagccacctcctccaactcaacaacattctataattgataactccctgagcctcaagacaccttccgagtgtctgctcactccccttccaccctcagctctaccctcagcggatgataatctcaagacacctgccgagtgcctgctctatccccttccaccctcagcggatgataatctcaagacacctcccgagtgtctgctcactccccttccaccctcagctccaccctcagcggatgataatctcaagacacctcctgagtgtgtctgctcactccccttccaccctcagcggatgataatctcaagaaactaaggaagaataaataaataatataaaaataaaaaaaaaaaaaaaaaactcgaggggggggcccggggccccaatttcgccctttttggggaggcggttattacaaattcacttggcccggcgtttttaacaaccttctgggaatggggaaaaaaccctgggcggtt

SEQ ID NO: 312112 - DNA, 2441 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagaggttgatggacggatggctacatggatgtgatggagatggtttactatcgggaccttccgcatcctgctgatgttttgttgcttaggatatgaatggctgagcggaggctgtaaaacctggcactctgcttgggtatgaggttcttcctgccatcctgccatcatttgttttttatgttttgtcgccaaaagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgttatcaatactctggctgaccatcgtcatcgtgggactgactttggtggaagtccttggttacttatcattactgtgtttctgagaagttataaatttgccatctccctctgcacaagttacctttgtgtgtctttcctgaagactatcttcccg

SEQ ID NO: 312113 - DNA, 2160 bp, Homo sapiens
gggctgcggcagtgccatctctcacagcacacgaagcaccgggatgatcctcctagtagaagctctgcattcaggcgtcaactccggtgtcggtttccgggcagactcccaccccgacgtgccgggctcagtgcccagtgctacccaaacccagagcacccctacttcccggcaggcgtgtgacctgcgcgttctgccccaggccgctacctgtctgaggaacccgagccctacctggcagtctacctgcactcggagccccggcccaatgagcgcaactgctcggctagcaggaggatccgcccagagtccctccagggtgccgaccaccggccctacaccttcttcatttccccggggaccagagacccagtggggagttaccgtctgaacctctccagccacttccgctggtcggcgctggaggtgtccgtgggcttgtacacgtccctgtgccagtacttcagcgaggaggacgtggtgtggcggacagaggggctgctgcccctggaggagacctcgccccgccaggccgtctgcctcacccgccacctcaccgccttcggcaccagcctcttcgtgcccccaagccatatccgctttgtgtttcctgagccaacagcggatgtaaactacatcgtcatgctgacatgtgctgtgtgcctggtgacctacatggtcatggccgccatcctgcacaagctggaccagttggatgccagccggggctgcgccatccccttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagtctggacatcttccagatcgccaccccgcacagcctgggtagcgtgtggaagatccgagtgtggcacgacaacaaaggtctgtatggaccctgccaagctctgcccctctgcccctgcattggggcgccctgcgaacctgacctccctcccgcgcctctgcagggctcagccctgcctggttcctgcagcacatcatcgtcagggacctgcagacggcacgcagcaccttcttcctggtcaatgactggctttcggtggagacggaggccaacgggggcctggtggagaaggaggtgctggccgcgagtaaggcctcgttccgtgttcccactccgtgggaggttgggcagggtggtcctgccccgtggcctcctgcagtgcggccctccctgccttctaggtcacgcagccctgttgcgcttccggcgcctgctggtggctgagctgcagcgtggcttctttgacaagcacatctggctctccatatgggaccggccgcctcgtagctgtttcactcgcatccagagggccacctgctgcgttctcctcatctgtctcttcctgggcgccaacgccgtgtggtacggggctgttggagactctgcctacagcacggggcgtgtgtccaggctgaacccgctgagcgtcgacacagtcgctgttggcctggtgtccagcgtggttgtctatcccgtctacctggccatcctctttctcttccggatgtcccggagcaaggtggctgggagcccgagccccacacctgccgggcagcaggtgctggacgtcgacagctgcctggactcatccgtgctggacagctccttcctcacgttctcaggcctccacgctgaggtgagggctctactgggggtcctgccgccttggcgcagcttggactcaagaccctgtgcacctctcagcaggcctttgctggacagatgaagagtgacttgtttctggatgattctaagagtgaccttgaggaaccctgggagctcaggaaggaaggagcacccagaagcagggacagggagctggttggggaggaccagaaatcaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaaca

SEQ ID NO: 312114 - DNA, 894 bp, Homo sapiens
cacgacggctgcggccgctggggttggagctattcgatggagttgagtgtttggtggagtccgaatcaggctctttgtcaaagtcctggtctggatcagacatacttctcagaggcacagtcacgctaggctccgatccacctgatgagggccacgagatgtagggcttgttcctggatggaggctggcgagccaggttggtgggagcggggcctggtggagaaggaggtgctgccgcgagtcacgcagccctgttgcgcttccggcgcctgctggtggctgagctgcagcgtggcttctttgacaagcacatctggctctccatatgggaccggccacctcgtagctgtttcactcgcatccagagggccacctgctgcgttctcctcatctgcctcttcctgggcgccaacgccgtgtggtacggggctgttggtgactctgcctacagcacggggcatgtgtccaggctgagcccgctgagcgtcgacacagtcgctgttggcctggtgtccagcgtggttgtctatcccgtctacctggccatcctctttctcttccggatgtcccggagcaaggtggctgggagcctgagccccacacctgccgggcagtaggtgctggacatcgacagctgcctggactcgtccgtgctggacagctccttcctcacgttctcaggcctccacgctgaggttatcaatactctggctgaccatcgtcatcgtgggactgactttggtggaagtccttggttacttatcattactgtgtttctgagaagttataaatttgccatctccctctgcacaagttacctttgtgtgagtatactaactttctgtagaggtatacttgtaatcacaaataagaataaattatatgaaacaattc

SEQ ID NO: 312115 - DNA, 297 bp, Homo sapiens
acatcacacagcatctagcacgtaactgcaccccgggagtcgtgggcatctgctggcctcctgccggcctcctgccctgctgacagcttgctgtgccccctgcctgccccagtacgagcgggccctggacgtggcggcagagcccaagcacgagcggcagcgccgagcccagatacgcaagaacatcacggagactctggtgtccctgagggtccacactgtggatgacatccagcagatcgctgctgcgctggcccagtgcatggtaggatggccccacatgctctccccgccccg

SEQ ID NO: 312116 - DNA, 169 bp, Homo sapiens
  misc_feature (10)..(10): n is a, c, g, or t
  misc_feature (24)..(24): n is a, c, g, or t
ttgggcgggngcctttgttgaaanaaaccccattttcacaaatagagtgtaacgaagtctggatttctgataccttgtcatttgggggattttattttactttgttgctttaaaattcaatgcagagaagttgttgactgtaggggaaataaagttaattcaaattttg

SEQ ID NO: 312117 - DNA, 3262 bp, Homo sapiens
  misc_feature (120)..(120): n is a, c, g, or t
tctcccaacaagagtccagacccttttcttttggggtgtatcactagctgcaggtgctgtgttccttagtgtcatctatttgacttatacaggttacattgcaccatggagtggcaggtntattcattgtgggatactgggtatgcaaaaatacacattccaattattgcatcagtgtctgagcatcaacctacgacttgggtgtctttcttctttgatctacatattcttgtatgtaccttcccagcaggcctttggttctgcatcaaaaatatcaacgatgaaagagtatttgttgctctatatgcaatcagtgctgtctactttgctggagtgatggtgcgactgatgttgactttgactccagtcgtgtgtatgctgtctgcaattgccttttcaaatgtttttgagcactatttgggggatgacatgaaaagggaaaatccacctgtggaggacagcagtgatgaggatgacaaaagaaaccaaggaaatttgtatgataaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttgaaaaaaaaaaaaatacacaaacaaaaacacaacactttgtgcgcggccgcgctcggcgccccagaaaagtttctaaaacccatccgtgtgggcgccgcgggcccagtaggtcacgtgagactggccaacaggggggcccaagagaaaccgggggctgcaaaggggtgcgtgcctccataaaaaaccgccgcgggaaccggcctgttgaacacccaaggtgtgcgacgccacgggccacacagggccaaggagcagtaatag

SEQ ID NO: 312118 - DNA, 3009 bp, Homo sapiens
  misc_feature (120)..(120): n is a, c, g, or t
tctcccaacaagagtccagacccttttcttttggggtgtatcactagctgcaggtgctgtgttccttagtgtcatctatttgacttatacaggttacattgcaccatggagtggcaggtntattcattgtgggatactgggtatgcaaaaatacacattccaattattgcatcagtgtctgagcatcaacctacgacttgggtgtctttcttctttgatctacatattcttgtatgtaccttcccagcaggcctttggttctgcatcaaaaatatcaacgatgaaagagtatttgttgctctatatgcaatcagtgctgtctactttgctggagtgatggtgcgactgatgttgactttgactccagtcgtgtgtatgctgtctgcaattgccttttcaaatgtttttgagcactatttgggggatgacatgaaaagggaaaatccacctgtggaggacagcagtgatgaggatgacaaaagaaaccaaggaaatttgtatgataaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttaacctgccactcccaaaccatcacccctcctgtttccttttgtaaagcaaaaccccactattgggattcgggtcgtcct

SEQ ID NO: 312119 - DNA, 1800 bp, Homo sapiens
catagtcgattatcgaggtcatatcagtcactggggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttg

SEQ ID NO: 312120 - DNA, 1621 bp, Homo sapiens
ggatccccgatcctacatagtgttctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttg

SEQ ID NO: 312121 - DNA, 1533 bp, Homo sapiens
agaaccatcactggtccaggttaatgtaccctctttgctgtgaaacacgacatgagctaaaggcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttg

SEQ ID NO: 312122 - DNA, 2819 bp, Homo sapiens
  misc_feature (120)..(120): n is a, c, g, or t
tctcccaacaagagtccagacccttttcttttggggtgtatcactagctgcaggtgctgtgttccttagtgtcatctatttgacttatacaggttacattgcaccatggagtggcaggtntattcattgtgggatactgggtatgcaaaaatacacattccaattattgcatcagtgtctgagcatcaacctacgacttgggtgtctttcttctttgatctacatattcttgtatgtaccttcccagcaggcctttggttctgcatcaaaaatatcaacgatgaaagagtatttgttgctctatatgcaatcagtgctgtctactttgctggagtgatggtgcgactgatgttgactttgactccagtcgtgtgtatgctgtctgcaattgccttttcaaatgtttttgagcactatttgggggatgacatgaaaagggaaaatccacctgtggaggacagcagtgatgaggatgacaaaagaaaccaaggaaatttgtatgataaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttattacagctaccacctgttgtgggaggcgatggtttcttttggaaacggttccctcccggaggcgggtcttccggggatctggtttagcttggccgggcttacaggggttccggggcggcgccggggttgccacgggggggtaaagccgcgggtgggtcgcgtg

SEQ ID NO: 312123 - DNA, 911 bp, Homo sapiens
cgtcgacactagcaggatcccccgtttatagcaccgtggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttg

SEQ ID NO: 312124 - DNA, 1193 bp, Homo sapiens
  misc_feature (120)..(120): n is a, c, g, or t
tctcccaacaagagtccagacccttttcttttggggtgtatcactagctgcaggtgctgtgttccttagtgtcatctatttgacttatacaggttacattgcaccatggagtggcaggtntattcattgtgggatactgggtatgcaaaaatacacattccaattattgcatcagtgtctgagcatcaacctacgacttgggtgtctttcttctttgatctacatattcttgtatgtaccttcccagcaggcctttggttctgcatcaaaaatatcaacgatgaaagagtatttgttgctctatatgcaatcagtgctgtctactttgctggagtgatggtgcgactgatgttgactttgactccagtcgtgtgtatgctgtctgcaattgccttttcaaatgtttttgagcactatttgggggatgacatgaaaagggaaaatccacctgtggaggacagcagtgatgaggatgacaaaagaaaccaaggaaatttgtatgataaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactgacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttg

SEQ ID NO: 312125 - DNA, 528 bp, Homo sapiens
caagaagagcagagagcttactaagtcatcatagtgcagtaaaccatgtgtgtgtttatagattttttaatcagtaagaaacctgcattaatactatgtgttttgtttttttatagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcata

SEQ ID NO: 312126 - DNA, 3001 bp, Homo sapiens
  misc_feature (120)..(120): n is a, c, g, or t
tctcccaacaagagtccagacccttttcttttggggtgtatcactagctgcaggtgctgtgttccttagtgtcatctatttgacttatacaggttacattgcaccatggagtggcaggtntattcattgtgggatactgggtatgcaaaaatacacattccaattattgcatcagtgtctgagcatcaacctacgacttgggtgtctttcttctttgatctacatattcttgtatgtaccttcccagcaggcctttggttctgcatcaaaaatatcaacgatgaaagagtatttgttgctctatatgcaatcagtgctgtctactttgctggagtgatggtgcgactgatgttgactttgactccagtcgtgtgtatgctgtctgcaattgccttttcaaatgtttttgagcactatttgggggatgacatgaaaagggaaaatccacctgtggaggacagcagtgatgaggatgacaaaagaaaccaaggaaatttgtatgataaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttg

SEQ ID NO: 312127 - DNA, 3038 bp, Homo sapiens
  misc_feature (120)..(120): n is a, c, g, or t
tctcccaacaagagtccagacccttttcttttggggtgtatcactagctgcaggtgctgtgttccttagtgtcatctatttgacttatacaggttacattgcaccatggagtggcaggtntattcattgtgggatactgggtatgcaaaaatacacattccaattattgcatcagtgtctgagcatcaacctacgacttgggtgtctttcttctttgatctacatattcttgtatgtaccttcccagcaggcctttggttctgcatcaaaaatatcaacgatgaaagagtatttgttgctctatatgcaatcagtgctgtctactttgctggagtgatggtgcgactgatgttgactttgactccagtcgtgtgtatgctgtctgcaattgccttttcaaatgtttttgagcactatttgggggatgacatgaaaagggaaaatccacctgtggaggacagcagtgatgaggatgacaaaagaaaccaaggaaatttgtatgataaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaaggtgggtgccaagtgaaggcattaaagggtaacttaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgagaacagctgttttcgatttctaatgtgaagcaagacagagcactgctgtaaatgtctagcagcagattttttttttattggtacatattatccttcaaatctgagaatttggactaactgcaccaaagaaccctctaatttggtccctggcacatgcatacttgtcaatgtttttattcttttacaagacctgcattttatttgaattacccgaatagcaatatgtaaaatacaagtgacaaaatgtgatgagagcttcttgaaccggtaaactagtacaggtctgagaaagacatattagaagaatcattatacttccttgaattatatttattttcatgtttctctaatgcaaagaatgtttcatcaaatgtatattttctgttgcttactgtttgctctgagaagaagctgctgtttcaaagatggacctctgagtagctaattgattcaagtagtttttttatgttgacacattattactgctgttagcagtcgttttcaccaggtacttacagagcagatttcatacatcattcattcaagggctaaatttatattttttggaaatcatggcaactacacaggatgttgcttaccaggacggagttttggtatcttagtactgaagttagcactatgtttacatgcaaaagattaaggaaaaaacccttaaagtggacaggtatccaaagttcattttctgtgactcatcaaagtgacaaaagacttgtaacaactttgcctggacttttttcattttacaacagttcatccattcacaatgattttgttctctgctccatattttttaatcccttaagcatttgatgaaacactctttagtgctatatgcattttcttacttttgttaaaaatgtgacaattgtcaaaaaatgcactaaaatgtaaatggagattgaacaagttcactttccagcttataggcaactttatacagacttgaacattttctccagttgtttagtaaaagtgaaagagaaagggtttttcctgccacaggatataacttttttttatataacaagcataacacaccactgcttttggtggaaaagtgcagaatagtatgtaccttttatgaagaaaaatgtaatttacaatattcagtgagaatgttactgctgattttcttttccaaggtgtagaatattctttgatttatagaattcatttttgacccagatgatggttcctttacagaacaataaaatggctgaacattttcacaaatagagtgtaacgaagtctggatttctgataccttgtcatttgggggattttattttactttgttgctttaaaattcaatgcagagaagttgttgactgtaggggaaataaagttaattcaaattttg

SEQ ID NO: 312128 - DNA, 1622 bp, Homo sapiens
  misc_feature (120)..(120): n is a, c, g, or t
tctcccaacaagagtccagacccttttcttttggggtgtatcactagctgcaggtgctgtgttccttagtgtcatctatttgacttatacaggttacattgcaccatggagtggcaggtntattcattgtgggatactgggtatgcaaaaatacacattccaattattgcatcagtgtctgagcatcaacctacgacttgggtgtctttcttctttgatctacatattcttgtatgtaccttcccagcaggcctttggttctgcatcaaaaatatcaacgatgaaagagtatttgttgctctatatgcaatcagtgctgtctactttgctggagtgatggtgcgactgatgttgactttgactccagtcgtgtgtatgctgtctgcaattgccttttcaaatgtttttgagcactatttgggggatgacatgaaaagggaaaatccacctgtggaggacagcagtgatgaggatgacaaaagaaaccaaggaaatttgtatgataaggcaggtaaagtgaggaaacatgcaactgaacaggaaaaaactgaagagggattaggccctaatataaaaagcattgtcaccatgttgatgctgatgctattgatgatgtttgctgtccactgtacctgggtcacaagcaatgcctactctagtccaagtgtagtcctggcctcatacaatcatgatggcaccaggaatatcttagatgattttagagaagcttacttttggctaaggcaaaatacagatgaacatgcacgagtaatgtcttggtgggattatggctatcagatagctggaatggctaatagaactacgttggtggataataacacctggaataacagccacatagcactggtgggaaaagctatgtcttctaatgaaacagcagcctataaaatcatgaggactctagatgtagattatgttttggttatttttggaggggttattggctattctggtgatgatatcaacaaatttctctggatggttaggatagctgaaggagaacatcccaaagacattcgggaaagtgactattttaccccacagggagaattccgtgtagacaaagcaggatcccctactttgttgaattgccttatgtataaaatgtcatactacagatttggagaaatgcagctggattttcgtacacccccaggttttgaccgaacacgtaatgctgagattggaaataaggacattaaattcaaacatttggaagaagcctttacatcagaacactggcttgttaggatatataaagtaaaagcacctgataacagggagacattagatcacaaacctcgagtcaccaacattttcccaaaacagaagtatttgtcaaagaagactaccaaaaggaagcgtggctacattaaaaataagctggtttttaagaaaggcaagaaaatatctaagaagactgtttaaatgcactgttctggttcctaacttgaagcagttgtccttgtgagaaccggtctttgcctttagctcatgtcgtgtttcacagcaaagagggtacagaaccatcactggtccaggttaatgtacaaaattttctggcaatgcctgattaaaaaaataaaattggcttgttgaga

SEQ ID NO: 312129 - DNA, 835 bp, Homo sapiens
gaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtgggcgggatcttcccgcggatttgggcaagcggccttggggctttgtgagatagctagggtcgacttgtgtggattctagtagaacggagctgaccctatccgaacaggcccctgccctgcttggatagaggcctccgaacaggagtaaagaatggctgttgaacatccacaaggcacctgcaagatcccccacaggcgctgcctgagacccagctctgtgtctcctcgtcgtacagcttgtggagctccgactgcaaggccatcagcatgcccaggcaggggttaagctggagggccatggaggaggacaggccagcaggatgccgcttctgctccagggcatgcaccatgctggctcatgcctgtaatcccagcactttgggaggccgagatgggcagatcacctgaggttgggagttcaagaccagcctgaccagcatggagaaacaccgtctctactaaaaatacaaaaattagccgggcgtagtggcgcatgcctgtaatcccagctactcgggaggctgaggcaggagaatcgcttgaacccaggaggtggaggttgtggtgagccgagatcatgccattgtgctccagcctgggaaacaagagtgaaactctgtcccaaaaaaaataaaaatttattgtctactac

SEQ ID NO: 312130 - DNA, 2151 bp, Homo sapiens
cggggtgaaagaaagcttgccccagaggacttaaacaggcaagaaggacttggttaaagactattgcaatagtcaacttccaatacaacagcagctggagatttatagctaacgggctgggtgaaggagttaaaggatgctaaattactaagaggaagtgatgggcagtaggggctgagcaaagataacttctgacatagtcaaaccaactccctctcagaagaacctgatgtttcctgactgctttctccttcctcagccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatc

SEQ ID NO: 312131 - DNA, 689 bp, Homo sapiens
gaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtgggcgggatcttcccgcggatttgggcaagcggccttggggctttgtgagatagctagggtcgacttgtgtggattctagtagaacggagctgaccctatccgaacaggcccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagagatcccccacaggcgctgcctgagacccagctctgtgtctcctcgtcgtacagcttgtggagctccgactgcaaggccatcagcatgcccaggcaggggttaagctggagggccatggaggaggacaggccagcaggatgccgcttctgctccagggcatgcaccatgcgtgagatattctaattatatacacgttcataaacatatgctcacatgcacagagtatgatac

SEQ ID NO: 312132 - DNA, 597 bp, Homo sapiens
gaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtgggcgggatcttcccgcggatttgggcaagcggccttggggctttgtgagatagctagggtcgacttgtgtggattctagtagaacggagctgaccctatccgaacaggcccctgccctgcttggatagaggcctccgaacaggagtaaagaatggctgttgaacatccacaaggcacctgcaagatcccccacaggcgctgcctgagacccagctctgtgtctcctcgtcgtacagcttgtggagctccgactgcaaggccatcagcatgcccaggcaggggttaagctggagggccatggaggaggacaggccagcaggatgccgcttctgctccagggcatgcaccatgcgtgagatattctaattatatacacgttcataaacatatgctcacatgcacagagtatgatac

SEQ ID NO: 312133 - DNA, 1550 bp, Homo sapiens
gaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtgggcgggatcttcccgcggatttgggcaagcggccttggggctttgtgagatagctagggtcgacttgtgtggattctagtagaacggagctgaccctatccgaacaggcgtaagtgaggcggctcggagcctggcgcgacaggaactcccgacctgtgtgggctgcgtggggaacaggctaaggagcgattgtgaggagtgtgtacggttgtgactgggggcgtgtgtctgtgcgaccgtgtatggaactgtgagggcggggaggaggactttttgtttatgtttgtgcgggtgtgagtagagtttaattgtgaccgggttgggcactgtgtttgcgagtgtgaggttcctggaccgcggttgtgactgtatgtccccttggggtgtgtgtgtgtgtgtttactaccatttgccgaactgtgtgtagtatgccttaattttgaggtttgtggctgcttccgtgtgtgtgtgtgcgcgcgcgttggtgatattgttgatggagggtgcgtgtgaatttgttgtcattgtgaccccaaggtgtatgtcactgggaatttgagagatgcccacggactctgtggttgtgtccgtgtctacccccgtggtgtgtatgagtgtgtgattgtgtgttgtgtttaggtttggggtgcctgtgacgtttatgtccctgcggtgtgagtgagtttgtgtgactatgtgtccgtatagccaatgtaggtatggggagtctttgtctttgtgacttcagccattggagacccctgtgagctcagggacaggttctgcccagaacggcattgaccctaccgttgtctgtgatgcccggattaagcaggatgccctagacttctctgaccttcctctgtaggtgatgggcagtaggggctgagcaaagataacttctgacatagtcaaaccaactccctctcagaagaacctgatgtttcctgactgctttctccttcctcagccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagagatcccccacaggcgctgcctgagacccagctctgtgtctcctcgtcgtacagcttgtggagctccgactgcaaggccatcagcatgcccaggcaggggttaagctggagggccatggaggaggacaggccagcaggatgccgcttctgctccagggcatgcaccatgcgtgagatattctaattatatacacgttcataaacatatgctcacatgcacagagtatgatac

SEQ ID NO: 312134 - DNA, 1458 bp, Homo sapiens
gaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtgggcgggatcttcccgcggatttgggcaagcggccttggggctttgtgagatagctagggtcgacttgtgtggattctagtagaacggagctgaccctatccgaacaggcgtaagtgaggcggctcggagcctggcgcgacaggaactcccgacctgtgtgggctgcgtggggaacaggctaaggagcgattgtgaggagtgtgtacggttgtgactgggggcgtgtgtctgtgcgaccgtgtatggaactgtgagggcggggaggaggactttttgtttatgtttgtgcgggtgtgagtagagtttaattgtgaccgggttgggcactgtgtttgcgagtgtgaggttcctggaccgcggttgtgactgtatgtccccttggggtgtgtgtgtgtgtgtttactaccatttgccgaactgtgtgtagtatgccttaattttgaggtttgtggctgcttccgtgtgtgtgtgtgcgcgcgcgttggtgatattgttgatggagggtgcgtgtgaatttgttgtcattgtgaccccaaggtgtatgtcactgggaatttgagagatgcccacggactctgtggttgtgtccgtgtctacccccgtggtgtgtatgagtgtgtgattgtgtgttgtgtttaggtttggggtgcctgtgacgtttatgtccctgcggtgtgagtgagtttgtgtgactatgtgtccgtatagccaatgtaggtatggggagtctttgtctttgtgacttcagccattggagacccctgtgagctcagggacaggttctgcccagaacggcattgaccctaccgttgtctgtgatgcccggattaagcaggatgccctagacttctctgaccttcctctgtaggtgatgggcagtaggggctgagcaaagataacttctgacatagtcaaaccaactccctctcagaagaacctgatgtttcctgactgctttctccttcctcagccctgccctgcttggatagaggcctccgaacaggagtaaagaatggctgttgaacatccacaaggcacctgcaagatcccccacaggcgctgcctgagacccagctctgtgtctcctcgtcgtacagcttgtggagctccgactgcaaggccatcagcatgcccaggcaggggttaagctggagggccatggaggaggacaggccagcaggatgccgcttctgctccagggcatgcaccatgcgtgagatattctaattatatacacgttcataaacatatgctcacatgcacagagtatgatac

SEQ ID NO: 312135 - DNA, 1603 bp, Homo sapiens
gaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtgggcgggatcttcccgcggatttgggcaagcggccttggggctttgtgagatagctagggtcgacttgtgtggattctagtagaacggagctgaccctatccgaacaggcgtaagtgaggcggctcggagcctggcgcgacaggaactcccgacctgtgtgggctgcgtggggaacaggctaaggagcgattgtgaggagtgtgtacggttgtgactgggggcgtgtgtctgtgcgaccgtgtatggaactgtgagggcggggaggaggactttttgtttatgtttgtgcgggtgtgagtagagtttaattgtgaccgggttgggcactgtgtttgcgagtgtgaggttcctggaccgcggttgtgactgtatgtccccttggggtgtgtgtgtgtgtgtttactaccatttgccgaactgtgtgtagtatgccttaattttgaggtttgtggctgcttccgtgtgtgtgtgtgcgcgcgcgttggtgatattgttgatggagggtgcgtgtgaatttgttgtcattgtgaccccaaggtgtatgtcactgggaatttgagagatgcccacggactctgtggttgtgtccgtgtctacccccgtggtgtgtatgagtgtgtgattgtgtgttgtgtttaggtttggggtgcctgtgacgtttatgtccctgcggtgtgagtgagtttgtgtgactatgtgtccgtatagccaatgtaggtatggggagtctttgtctttgtgacttcagccattggagacccctgtgagctcagggacaggttctgcccagaacggcattgaccctaccgttgtctgtgatgcccggattaagcaggatgccctagacttctctgaccttcctctgtaggtgatgggcagtaggggctgagcaaagataacttctgacatagtcaaaccaactccctctcagaagaacctgatgtttcctgactgctttctccttcctcagccctgccctgcttggatagaggcctccgaacaggagtaaagaatggctgttgaacatccacaaggcacctgcaagacctctaacttcaccctggagttgagcagaaacatggcttgccttttccctcagatcagtcttggactccagacaaagggttggaactttgagccaataagcaggttactggtaacagtgcctgaggaaagacaaagctatgggtatcccccacaggcgctgcctgagacccagctctgtgtctcctcgtcgtacagcttgtggagctccgactgcaaggccatcagcatgcccaggcaggggttaagctggagggccatggaggaggacaggccagcaggatgccgcttctgctccagggcatgcaccatgcgtgagatattctaattatatacacgttcataaacatatgctcacatgcacagagtatgatac

SEQ ID NO: 312136 - DNA, 771 bp, Homo sapiens
gaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtgggcgggatcttcccgcggatttgggcaagcggccttggggctttgtgagatagctagggtcgacttgtgtggattctagtagaacggagctgaccctatccgaacaggcgtaagtgaggcggctcggagcctggcgcgacaggaactcccgacctgtgtgggctgcgtggggaacaggctaaggagcgattccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagagatcccccacaggcgctgcctgagacccagctctgtgtctcctcgtcgtacagcttgtggagctccgactgcaaggccatcagcatgcccaggcaggggttaagctggagggccatggaggaggacaggccagcaggatgccgcttctgctccagggcatgcaccatgcgtgagatattctaattatatacacgttcataaacatatgctcacatgcacagagtatgatac

SEQ ID NO: 312137 - DNA, 420 bp, Homo sapiens
tatctattataaacgtttaatctctcccagaacacaaaaaagtgaatgtttgcttttatattttctttcagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagt

SEQ ID NO: 312138 - DNA, 2184 bp, Homo sapiens
gaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtgggcgggatcttcccgcggatttgggcaagcggccttggggctttgtgagatagctagggtcgacttgtgtggattctagtagaacggagctgaccctatccgaacaggcccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatc

SEQ ID NO: 312139 - DNA, 1868 bp, Homo sapiens
agcaacacaagtagactaaggcatcaagttttaccacttaagattaaggtgactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatc

SEQ ID NO: 312140 - DNA, 3045 bp, Homo sapiens
gaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtgggcgggatcttcccgcggatttgggcaagcggccttggggctttgtgagatagctagggtcgacttgtgtggattctagtagaacggagctgaccctatccgaacaggcgtaagtgaggcggctcggagcctggcgcgacaggaactcccgacctgtgtgggctgcgtggggaacaggctaaggagcgattgtgaggagtgtgtacggttgtgactgggggcgtgtgtctgtgcgaccgtgtatggaactgtgagggcggggaggaggactttttgtttatgtttgtgcgggtgtgagtagagtttaattgtgaccgggttgggcactgtgtttgcgagtgtgaggttcctggaccgcggttgtgactgtatgtccccttggggtgtgtgtgtgtgtgtttactaccatttgccgaactgtgtgtagtatgccttaattttgaggtttgtggctgcttccgtgtgtgtgtgtgcgcgcgcgttggtgatattgttgatggagggtgcgtgtgaatttgttgtcattgtgaccccaaggtgtatgtcactgggaatttgagagatgcccacggactctgtggttgtgtccgtgtctacccccgtggtgtgtatgagtgtgtgattgtgtgttgtgtttaggtttggggtgcctgtgacgtttatgtccctgcggtgtgagtgagtttgtgtgactatgtgtccgtatagccaatgtaggtatggggagtctttgtctttgtgacttcagccattggagacccctgtgagctcagggacaggttctgcccagaacggcattgaccctaccgttgtctgtgatgcccggattaagcaggatgccctagacttctctgaccttcctctgtaggtgatgggcagtaggggctgagcaaagataacttctgacatagtcaaaccaactccctctcagaagaacctgatgtttcctgactgctttctccttcctcagccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatc

SEQ ID NO: 312141 - DNA, 2198 bp, Homo sapiens
cggggtgaaagaaagcttgccccagaggacttaaacaggcaagaaggacttggttaaagactattgcaatagtcaacttccaatacaacagcagctggagatttatagctaacgggctgggtgaaggagttaaaggatgctaaattactaagaggaagttaagtatcaagagtggggggattgttactaaactggcttagctggattcttgctgaagtgctgttcgcaggctatggaggaggcctggccaagcaaaaagggctcagaggagcctgactaaagcttggtctagggactccttgtcagccctgccctgcttggatagaggcctccgaacaggagtaaagaatggctgttgaacatccacaaggcacctgcaagactatgaatcaaagttgagaccaagaaattatttctgaaaaaggatatggaaaaccttacaaaacacagcattgagtgttcaagtttcagaggtgattgggaatgtaaaaaccagtttgagagaaaacagggatctcaggaaggacatttcagtgaaatgatatttactcctgaagacatgcccactttcagtatccagcatcagagaattcatactgatgagaaactccttgaatgtaaggaatgtgggaaggattttagttttgtatcagtccttgttcgacatcagcgaattcatactggtgagaaaccttatgaatgcaaagaatgtggcaaggcctttggtagtggtgcaaaccttgcttaccatcaaagaattcatactggtgagaagccttttgaatgtaaagaatgtgggaaggcctttggtagtggctcaaaccttactcaccatcagagaattcatactggtgagaaaccctatgagtgtaaggaatgtgggaaagcctttagttttggatcaggccttattcgacatcagatcattcacagtggtgagaagccttatgagtgtaaggaatgtgggaagtcctttagttttgaatcagcccttattcggcatcacagaattcacacaggtgagaaaccttatgaatgtatagattgtggtaaagcctttggcagtggttcaaaccttactcaacatcggcggattcatactggtgagaaaccttatgaatgcaaagcatgtggaatggcctttagcagtggttcggctcttactcggcatcagagaattcataccggtgagaaaccatatatatgtaatgaatgtggtaaggcctttagttttggatcagcccttactcgacatcaaagaattcatactggtgagaaaccttatgtatgtaaggaatgtgggaaggcttttaatagtggctcagatctcactcagcatcagagaattcacactggtgagaaaccctatgagtgtaaggagtgtgagaaagcctttagaagtggttcaaaacttattcagcatcaaagaatgcatactggagagaaaccttatgaatgtaaggaatgtgggaagacctttagtagtggttcagaccttactcaacatcacagaattcatactggtgagaaaccctatgaatgtaaggaatgtgggaaggcctttggtagtggctcaaaacttatccaacaccagctaatccatactggtgaaagaccctatgaatgtaaagaatgtggaaagtcctttagtagtggttcagctcttaatcggcaccagagaatacacactggtgagaaaccctatgaatgtaaggagtgtgggaaggctttttatagtggctcaagccttactcagcatcagagaattcatacaggtgagaaactttatgaatgtaagaactgtgggaaggcttatgggagggattcagagtttcagcaacataagaaaagtcataatggtaagaaactctgcgaattggaaactataaattgaaattatgtgctgaaggaaggactctaaacatatgacttaagaaaattcatagtggtgaaaatctctacaaatagaactaaggtacaaatgccttacttatgcttcacaggttagtcagtctaagaatatttatacaggaaaaaaatcaccccaaataaaataaatatttgaagatccttatctatattcattccttcattacttttggaaaattcttacttgtgaatgttaaaaatgaaaaaaaaatcatttattatattttgcctcaactttaaacattggaaaactcatttctgggttaatc

SEQ ID NO: 312142 - DNA, 300 bp, Homo sapiens
ggaggttgcagtgagccgagattgcgccattgcactccagcctgggcaacagagcaagactctgtctcaaaaagaaaaaaaaaaaaaaaaaaaccacacactttgtacttcattttctgacctgaaagcagctctgtaattttagttatcatgcctcagacctcctctagaaactgaaagattatcccacaatgccagccatttctctccgccacctggtgcttggtctgcctaacactgtgtttctagagaggtgaatttgcaggctctttaccatgtatagaaggtgaggtttttttt

SEQ ID NO: 312143 - DNA, 2713 bp, Homo sapiens
  misc_feature (1)..(1): n is a, c, g, or t
  misc_feature (3)..(3): n is a, c, g, or t
  misc_feature (5)..(6): n is a, c, g, or t
ngncnngagctggttgccggggcaggggcggaggcggaggcagaggtggaggcgctttgaaagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaa

SEQ ID NO: 312144 - DNA, 861 bp, Homo sapiens
  misc_feature (1)..(1): n is a, c, g, or t
  misc_feature (3)..(3): n is a, c, g, or t
  misc_feature (5)..(6): n is a, c, g, or t
ngncnngagctggttgccggggcaggggcggaggcggaggcagaggtggaggcgctttgaaagccgtcattgtgtggcactggacggggaatcaagagacccggtttctaatccctgctctgtcactaacaagctgcgtgatcttcggaaaaaagtaatcctcttggaaagctggaaacatagtccggtaagattcccattgctcaaaaaatttttggcattgaatttttgtaattaccttcagaattcgcagcacattttttgaagatttttaatggtagttaattctcatcttcttaagttggatttcatttctgcaagctgctaacaggtccttataaccgagacaagtgaatgaagtgggtgttaaagtcactgtttgggataaaaaatgaagtgtgattattttcatatttttagattttttatagtgtgtggtttatagaaagactccaggaatattctgtgctgtggtggaaatattggaataatcagcctcataaggtgatttctttggtggggatagctgtcagttcaatatatacctctaacatgtagtttgaggtcggtctcattacattgtcatatttctattccctaacaaccacagaactacatatgttattttttctagttatcttacgtgtcactaattgttcttttaatatatacttgtgataattttaatggaattcattcttttctaaatgataaactgacagcttttgttttccttcccaatactatgctctgctttgccgtggaacttacttgttttattcacttaactacattattggattgttagttaagttttctattggttatattgtgtatttaactttgaggggaaagccactc

SEQ ID NO: 312145 - DNA, 3191 bp, Homo sapiens
  misc_feature (1)..(1): n is a, c, g, or t
  misc_feature (3)..(3): n is a, c, g, or t
  misc_feature (5)..(6): n is a, c, g, or t
ngncnngagctggttgccggggcaggggcggaggcggaggcagaggtggaggcgctttgaaaggtgagagcgcgagggcggtgcggggctgtctcccggctgggactcgctcgcgctcccggtgctaatggtttatgagagggcgggggaagccgtgcctcctcgcggactaagagaaaaattcccgcgggcgctctttgggtgggccggagaacgcccctcagccctttgcgcctctaaccctcctcagctgagctgcagtgggcgcggtgcccgttatttccgccttggggaggtgcttggaactgatgtagggagctcggttggtgatttctcgggtttctggcctttccagacccttgtaattgttttctcggtgcagagctcttttggggtctgggggtttccgtcgtcctgcgcgcgtcatcgcgaagcttggcctgagggtccggtttcctagctactgtgcccctccctcctggaggcagagtgacggactagtgggctagcgggcgctgggttcctgcgtcccgccaaagagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaa

SEQ ID NO: 312146 - DNA, 2941 bp, Homo sapiens
ggctcactggggactcctttaaattttgcaattggtgttattaataagatgataagagggaagtctgcaaatactcttttcttgcctggtggataataatttacagaagtttctggcctaactcgtgcagtaaaattcggttacataattttttaaaaaagcatatttgtaaactctaaaccattttaatcgttatttttctgaaactaaaatacagcatgaatgagagataaaaataatgatttttaaaggcttaatttttactatcttgtacaaatgtgatattggcagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaa

SEQ ID NO: 312147 - DNA, 3275 bp, Homo sapiens
  misc_feature (1)..(1): n is a, c, g, or t
  misc_feature (3)..(3): n is a, c, g, or t
  misc_feature (5)..(6): n is a, c, g, or t
ngncnngagctggttgccggggcaggggcggaggcggaggcagaggtggaggcgctttgaaaggtgagagcgcgagggcggtgcggggctgtctcccggctgggactcgctcgcgctcccggtgctaatggtttatgagagggcgggggaagccgtgcctcctcgcggactaagagaaaaattcccgcgggcgctctttgggtgggccggagaacgcccctcagccctttgcgcctctaaccctcctcagctgagctgcagtgggcgcggtgcccgttatttccgccttggggaggtgcttggaactgatgtagggagctcggttggtgatttctcgggtttctggcctttccagacccttgtaattgttttctcggtgcagagctcttttggggtctgggggtttccgtcgtcctgcgcgcgtcatcgcgaagcttggcctgagggtccggtttcctagctactgtgcccctccctcctggaggcagagtgacggactagtgggctagcgggcgctgggttcctgcgtcccgccaaagagccgtcattgtgtggcactggacggggaatcaagagacccggtttctaatccctgctctgtcactaacaagctgcgtgatcttcggaaaaaagtaatcctcttggaaagctggaaacatagtccgattttttatagtgtgtggtttatagaaagactccaggaatattctgtgctgtggtggaaatattggaataatcagcctcataagaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaa

SEQ ID NO: 312148 - DNA, 1789 bp, Homo sapiens
  misc_feature (1)..(1): n is a, c, g, or t
  misc_feature (3)..(3): n is a, c, g, or t
  misc_feature (5)..(6): n is a, c, g, or t
ngncnngagctggttgccggggcaggggcggaggcggaggcagaggtggaggcgctttgaaaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaa

SEQ ID NO: 312149 - DNA, 2857 bp, Homo sapiens
  misc_feature (1)..(1): n is a, c, g, or t
  misc_feature (3)..(3): n is a, c, g, or t
  misc_feature (5)..(6): n is a, c, g, or t
  misc_feature (2725)..(2725): n is a, c, g, or t
  misc_feature (2727)..(2727): n is a, c, g, or t
  misc_feature (2734)..(2734): n is a, c, g, or t
  misc_feature (2744)..(2744): n is a, c, g, or t
  misc_feature (2752)..(2754): n is a, c, g, or t
  misc_feature (2766)..(2766): n is a, c, g, or t
  misc_feature (2768)..(2768): n is a, c, g, or t
  misc_feature (2776)..(2777): n is a, c, g, or t
  misc_feature (2779)..(2779): n is a, c, g, or t
  misc_feature (2791)..(2791): n is a, c, g, or t
ngncnngagctggttgccggggcaggggcggaggcggaggcagaggtggaggcgctttgaaagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaaaaaaaaaaaaananacaaaanaaaaactttntgggggcnnngggcccggaaanantttttaanncnctttgtttgggngcgggggccccatgtttgtaactcttggcaaaggggtccccaggagaacccgggcgaacaaggggg

SEQ ID NO: 312150 - DNA, 1442 bp, Homo sapiens
  misc_feature (1)..(1): n is a, c, g, or t
  misc_feature (3)..(3): n is a, c, g, or t
  misc_feature (5)..(6): n is a, c, g, or t
ngncnngagctggttgccggggcaggggcggaggcggaggcagaggtggaggcgctttgaaagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttgtaagttcaatattaagaaaatgtttcatgaattgttctcatgatattttatcaagtatcaaattagccttttaatatcatgttctaaatcattgactagaaactgtggtttcattttcagataaccttgtcagtttaatagtttattccagtggtctcaggaaccatttacatttttcaaaattattaaccccaacacgcctttacttcaatgagttatgcctgtcaatatttaccattgtagaaatca

SEQ ID NO: 312151 - DNA, 1285 bp, Homo sapiens
  misc_feature (1)..(1): n is a, c, g, or t
  misc_feature (3)..(3): n is a, c, g, or t
  misc_feature (5)..(6): n is a, c, g, or t
ngncnngagctggttgccggggcaggggcggaggcggaggcagaggtggaggcgctttgaaaggtgagagcgcgagggcggtgcggggctgtctcccggctgggactcgctcgcgctcccggtgctaatggtttatgagagggcgggggaagccgtgcctcctcgcggactaagagaaaaattcccgcgggcgctctttgggtgggccggagaacgcccctcagccctttgcgcctctaaccctcctcagctgagctgcagtgggcgcggtgcccgttatttccgccttggggaggtgcttggaactgatgtagggagctcggttggtgatttctcgggtttctggcctttccagacccttgtaattgttttctcggtgcagagctcttttggggtctgggggtttccgtcgtcctgcgcgcgtcatcgcgaagcttggcctgagggtccggtttcctagctactgtgcccctccctcctggaggcagagtgacggactagtgggctagcgggcgctgggttcctgcgtcccgccaaagagccgtcattgtgtggcactggacggggaatcaagagacccggtttctaatccctgctctgtcactaacaagctgcgtgatcttcggaaaaaagtaatcctcttggaaagctggaaacatagtccggtaagattcccattgctcaaaaaatttttggcattgaatttttgtaattaccttcagaattcgcagcacattttttgaagatttttaatggtagttaattctcatcttcttaagttggatttcatttctgcaagctgctaacaggtccttataaccgagacaagtgaatgaagtgggtgttaaagtcactgtttgggataatagaaagactccaggaatattctgtgctgtggtggaaatattggaataatcagcctcataaggtgatttctttggtggggatagctgtcagttcaatatatacctctaacatgtagtttgaggtcggtctcattacattgtcatatttctattccctaacaaccacagaactacatatgttattttttctagttatcttacgtgtcactaattgttcttttaatatatacttgtgataattttaatggaattcattcttttctaaatgataaactgacagcttttgttttccttcccaatactatgctctgctttgccgtggaacttacttgttttattcacttaactacattattggattgttagttaagttttctattggttatattgtgtatttaactttgaggggaaagccactc

SEQ ID NO: 312152 - DNA, 750 bp, Homo sapiens
  misc_feature (1)..(1): n is a, c, g, or t
  misc_feature (3)..(3): n is a, c, g, or t
  misc_feature (5)..(6): n is a, c, g, or t
ngncnngagctggttgccggggcaggggcggaggcggaggcagaggtggaggcgctttgaaaggtgagagcgcgagggcggtgcggggctgtctcccggctgggactcgctcgcgctcccggtgctaatggtttatgagagggcgggggaagccgtgcctcctcgcggactaagagaaaaattcccgcgggcgctctttgggtgggccggagaacgcccctcagccctttgcgcctctaaccctcctcagctgagctgcagtgggcgcggtgcccgttatttccgccttggggaggtgcttggaactgatgtagggagctcggttggtgatttctcgggtttctggcctttccagacccttgtaattgttttctcggtgcagagctcttttggggtctgggggtttccgtcgtcctgcgcgcgtcatcgcgaagcttggcctgagggtccggtttcctagctactgtgcccctccctcctggaggcagagtgacggactagtgggctagcgggcgctgggttcctgcgtcccgccaaagaggtttgtaatcatgaaagttcacccttccgggtgttaattcctgagaggatctactccactgtctaccactcattcctgctgcattaaccttcattgttaacggattttaatgaataatatagttatcccggataccatgctggcaggatccactttgcgaaattgtggactgttggactgtgattctaagtgggggaaataggctttag

SEQ ID NO: 312153 - DNA, 2705 bp, Homo sapiens
gaagcaggcgcaagttcgcagcgacgctttgagttgcccgttatgtgtcgtggatctgggcatgtgcaatccccgagagccgcgagctactaataccgcatgcatctgtaaactaactgatactgagtgatctttcggaaaataagtactcctcttggaaagctggaaacactagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaa

SEQ ID NO: 312154 - DNA, 2589 bp, Homo sapiens
  misc_feature (1)..(1): n is a, c, g, or t
  misc_feature (3)..(3): n is a, c, g, or t
  misc_feature (5)..(6): n is a, c, g, or t
ngncnngagctggttgccggggcaggggcggaggcggaggcagaggtggaggcgctttgaaagaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaa

SEQ ID NO: 312155 - DNA, 1584 bp, Homo sapiens
  misc_feature (1)..(1): n is a, c, g, or t
  misc_feature (3)..(3): n is a, c, g, or t
  misc_feature (5)..(6): n is a, c, g, or t
ngncnngagctggttgccggggcaggggcggaggcggaggcagaggtggaggcgctttgaaagattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagaaaatggctggattaaggagaaatatggtcaacttgaagaatatctcaattttgcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaa

SEQ ID NO: 312156 - DNA, 2659 bp, Homo sapiens
  misc_feature (1)..(1): n is a, c, g, or t
  misc_feature (3)..(3): n is a, c, g, or t
  misc_feature (5)..(6): n is a, c, g, or t
ngncnngagctggttgccggggcaggggcggaggcggaggcagaggtggaggcgctttgaaagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaagagtcacgtgcctgagcagaaatctcgagttgattggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgacagtgatgagagtgatgacagcgatatcctagttagaaaagtaggtgttaaacgtccccgtagagtggttgaagatgaaggttcttcagtggaaatggagcaaaagactcctgaaaaaacattagctgcacaaaagcgagaaaaacttcagaagctcaaagaactctcaaaacaaagatctcgtcagagacgcagtagtggtagagattttgaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacagaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgttcactgttggcagaatttgtgccagccgtaccagaatttatcataaactgaaacattttaaattcaaactataccaggaatgttgcaccattgcaatgacagaagaagttgaagatgaacaagttaaagaaacagtggaaagaattttcaggcggtcaaaagcggattactttcaagaagagaagtttgagttgtaacacatttccatcagagaagattttttaaattcctgtaaatgtgaagatcatgattcttgtttttctgtatcatgtgacatgtttgtacattttatctatatcttcatggcaaaatattttgtttaaaacatgattatcttaattcctgtgaagtggcactctacactctaattaaacttttatctgatgtacataaaagcattatcttaatttttaagtctgtaaatatattttaaagttatataataatggctttataacagatgactgtcaagtgaatgagctgttgatatcctgtcagtttagtcaaaatatattgtatcttaaaaatgtatttagactaacgtctacatgtatttttacggaattcctgtccagatctgtttattcttttacagtattaaatgattttcactaatatattttttactgctatcatctaaatcagtgggccatggaagaaacctcatatatcattcagttcaatcccattgcttcagaatcagatcatagcatatctattctaagtagaggaatgcttttttccttttcttgaaagtttctctttcaaatagatttcaggcctctagagtctttcaaccctcacattcaggaataattttatgtaaattttcatgctttataatgttcttacttttttctattcaattttgtctatatattgatgattaagatgtattttatttatttttatccatagctttttccatataagtatgtatcttagggtcagaactgctgaaagagacaaactcagccaaaaacacttggaaagcatattttggtatctgcattgctttgcatatctaaattttcccataaagtaataaagtaaaatggttgcagagtgaacaaa

SEQ ID NO: 312157 - DNA, 300 bp, Homo sapiens
gcacagggaacatgactatgagtatccaactagccctgccttccaagtgttcattggctagaactgaatgcaagcagatgatgtaaggttacgttaaatagaaaagcagaaactatgaagtctgagagacacctaataagggacacacagtttcacatctgctttgttgcttagcgaccaagttcagcttcagaagatggataccacagaatacgacaattccaaaaagacctacctttgtggaatgattcaagcttcagaatttttcacgttttattatgactactgaggctttttatc

SEQ ID NO: 312158 - DNA, 3132 bp, Homo sapiens
gcggccgcggctcccgagctcctcgggctctgggtcccggcgcccctccggccgcgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccccgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatttcattttt

SEQ ID NO: 312159 - DNA, 3050 bp, Homo sapiens
gcggccgcggctcccgagctcctcgggctctgggtcccggcgcccctccggccgcgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccccgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagt

SEQ ID NO: 312160 - DNA, 534 bp, Homo sapiens
ccccgggtgcgggattcggccggggtttcatttataacaaaagttaaggattaagtgcatttcccttttaaaaatactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatttcattttt

SEQ ID NO: 312161 - DNA, 3242 bp, Homo sapiens
gcggccgcggctcccgagctcctcgggctctgggtcccggcgcccctccggccgcgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagcattttgcctgcaggctagaatctgtgttgttcattgcagtttgtgctcagccacggaaggcacctatccctagcacccaacccccatccacctagggctctataaaaagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccccgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatttcattttt

SEQ ID NO: 312162 - DNA, 3071 bp, Homo sapiens
gcggccgcggctcccgagctcctcgggctctgggtcccggcgcccctccggccgcgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccccgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtatttttttactgaaatgtgtttattctatagcaagataaaagcatttttgttttagttaagcaaaatacaaacgtcgacg

SEQ ID NO: 312163 - DNA, 343 bp, Homo sapiens
caacgcagtgagctcatcaatatgccagcagatgatctaagccccaaatcatcaccttctcgggaaagacagacaaacaaaaacagccggaaggagggcgggcaggcgggctgggaggggctgtcggcggcgaggcggagaagcgcggccggccggggctgcggggggctgcaaggagggcgtgtgcgctggcgctcgggctcgggcagcggcttcgtttcagccgcgggcgctggggccggcgttgccttggcgaccgcgtcgcgctcgaagccgcagcctccgcccccgccgccgccgccagagcccacccggcgggtgcagattccctttgtctcctccg

SEQ ID NO: 312164 - DNA, 424 bp, Homo sapiens
gtctagtgtgtgcttcttagtactgaacttgatataacttccaaaagcgctcactcaagtagtagtacatattattctaagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgta

SEQ ID NO: 312165 - DNA, 5485 bp, Homo sapiens
ggcagccgcgcagagcgcgcacccaagcggccggacctccccgactcccgggccgcccccgtctcgcgccctgcctccctccttcggccttcacctacccgcctccggattggccgctaggaatcccgcccctctaaagccctgcctgctattggtcacgattttataatcaatggataaagtgggaaaaatgtggaataacttcaaatacaggtgtcagaatctcttcggtcatgagggaggaagccgtagtgaaaatgtggacatgaactccaacagatgtttgtctgtcaaagagaaaaacatcagcataggagactcaactcctcagcaacaaagcagtcccttaagagaaaatattgccttacaactgggattaagcccttcgaagaattcttcaaggagaaatcaaaattgtgccacagaaatccctcaaattgttgaaataagcatcgaaaaggataatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctctctgaattaatgcttgagaaatgcccttttcctgctggctcagatttagcccaaaaatggcatttgattaaacagcatacagctcctgtgagcccacattcaacattttttgatacatttgatccatctttggtttctacagaagatgaagaagataggcttagagagagaaggcggcttagtattgaagaaggggttgatccccctcccaatgcacaaatacatacatttgaagctactgcacaggttaatccattatataaactgggaccaaaattagctcctggaatgactgaaataagtggggacagttctgcaattccacaagctaattgtgactcggaagaggatacaaccaccctgtgtttgcagtcacggaggcagaagcagcgtcagatatctggagacagccatacccatgttagcagacagggagcttggaaagtccacacacagattgattacatacactgcctcgtgcctgatttgcttcaaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcccatgacccgtgtgtatttcactcctccactgtaacgggacttttagaacattataaagatcccagttcgtgcatgttttttgaaccattgcttactatatcactaaataggactttcccttttagcctgcagtatatctgtcgcgcggtaatctgcaggtgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaagggtgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcagttcacttacgtgttgatgtagtttataatcagacgccttttctcttctgcaaaaggtactgttaagtaaaccagattttctaaataggcattcttaaaatttcagacttacaaagctagtagtagaattttattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttatagaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgtatatctgctgttttatacatttgcaacaatttctcttgtaaatggaatggtttggggtttttaaataagcattaactaacaacctttctatagttaatgcagagttaatgaacagtctaatattgacttatcagaataagctaactctaaatttaatgctctacatcttatcagtcataattatatatactgtggaacagtatctgtagttactgcaaattactgtacagtttaggttataacagaaaactgacagagaagtaataaacctattgatttctctgcttataaatgaaagattgaaactatccaatgacatattatagtaaatgagtatctgtaacctcccactgcatcagaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgagaaaaagaaaagttcatactgattattggaaaaggactatatatgtgagcaagattgtgttttagagaggaaacttgaaactccaagaaagcacttgatgtttttatatgcttgtagcaaattgatgttctaactgtagttttatagaaagtattaatgcttttatgtatttcaaaactttcatatgttaaatggaaattgttttaaatgtgtttgagtttatgtaagcatgtatacactgtgctaaaagtcacatgtttcagtttgtgtataatattaatatgcaatttttggtttaaatttttgtcttaaaatattagtggcttacattttaaaaaagaaaaatcaccagcatgaacttgcacctaagtctatattcactgtgtccttttctgaatcccattgtagcctgtcaactaaatttgagtgttaacggtctttttaaagtgcatttaaatacaaaccaggaatttctttagaagttgagatacatctttatagttgaaataattaacccaagaaaaggttgctttgatttgtacccattctcattcattttcttcattcccttacacacacacacacacctctcccttccgcatacatataagtgtgtattatatatttatgtatgcacatatatacatttatgttgttaatattactttagatggcatttccacctgatacaaaaacatttagagatcttattctatagatattacctaaagagtattcttgtactattcgaattttattatctgcactaaaagtttagccttgctactttagccttgtttataatacagtcaccttacaaagagaaagagttcatctgtattttgttttctggctaaacacagtacaaaatatttgaagaaaaacagcttggattaaatagttactaagagttataattaaatttatgtttcttagacaaaaaaaaaaaaaaaaaaaaaaaaaaaaaaaaaaaaaaaaaaaaaaaaaaagaaaaaaaaaaaaaaaaaagaacaacaaagaatacaaagaacaaacaaaagcagtacaaactacaggcaaagcagaagaaagagacagccacacgaacgaaacccgcaaacagagacagcagaagaggaaaaacaaaacaagaaacgaacgagaagagacgaacacgagcaagataaaaaaaaagccaaagcgacctacgaagaaccaagaacagaaagagaaagaaaccagatagaaaacaagaacgacgcgagaggagacaaagaaaggataaaagagcaaggagacagaaatgagagagcagccaagcacgcaacgcgcagcgcacaggctccatagacaagaacaaaaagacagaaacggaagaaacgaacagaacaagaaccaacaccgaggaagacaaaaacgagacagaacaggaaggacaagaacgaacgacagagaaaaggaaaaacgaaagaacgaaaagagcacaacgaaagaaaagcaggaacaagaacgacacaagaaaacacaccagaacaaacaaacagaaaagaaggcaaaacaaa

SEQ ID NO: 312166 - DNA, 3348 bp, Homo sapiens
tggtgggggttggggggaggggggaggggaaacgggtgaagaaggggaggcggcggcctggcgggggcatccggcggagctggggtccccgggctccgtccggaggaagcgacgctgcgctcgctgggcagtcggaggggacgggacgcaccggagggcaggcggactcgccctgtcggtgactgcgccgtccgggcccgtcctgcctggccgcaggtgccctggatgaggccgccccgcgcgccccaaacgattttataatcaatggataaagtgggaaaaatgtggaataacttcaaatacaggtgtcagaatctcttcggtcatgagggaggaagccgtagtgaaaatgtggacatgaactccaacagatgtttgtctgtcaaagagaaaaacatcagcataggagactcaactcctcagcaacaaagcagtcccttaagagaaaatattgccttacaactgggattaagcccttcgaagaattcttcaaggagaaatcaaaattgtgccacagaaatccctcaaattgttgaaataagcatcgaaaaggataatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctctctgaattaatgcttgagaaatgcccttttcctgctggctcagatttagcccaaaaatggcatttgattaaacagcatacagctcctgtgagcccacattcaacattttttgatacatttgatccatctttggtttctacagaagatgaagaagataggcttagagagagaaggcggcttagtattgaagaaggggttgatccccctcccaatgcacaaatacatacatttgaagctactgcacaggttaatccattatataaactgggaccaaaattagctcctggaatgactgaaataagtggggacagttctgcaattccacaagctaattgtgactcggaagaggatacaaccaccctgtgtttgcagtcacggaggcagaagcagcgtcagatatctggagacagccatacccatgttagcagacagggagcttggaaagtccacacacagattgattacatacactgcctcgtgcctgatttgcttcaaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcccatgacccgtgtgtatttcactcctccactgtaacgggacttttagaacattataaagatcccagttcgtgcatgttttttgaaccattgcttactatatcactaaataggactttcccttttagcctgcagtatatctgtcgcgcggtaatctgcaggtgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaagggtgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcagttcacttacgtgttgatgtagtttataatcagacgccttttctcttctgcaaaaggtactgttaagtaaaccagattttctaaataggcattcttaaaatttcagacttacaaagctagtagtagaattttattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttatagaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgta

SEQ ID NO: 312167 - DNA, 1206 bp, Homo sapiens
tggtgggggttggggggaggggggaggggaaacgggtgaagaaggggaggcggcggcctggcgggggcatccggcggagctggggtccccgggctccgtccggaggaagcgacgctgcgctcgctgggcagtcggaggggacgggacgcaccggagggcaggcggactcgccctgtcggtgactgcgccgtccgggcccgtcctgcctggccgcaggtgccctggatgaggccgccccgcgcgccccaaacgattttataatcaatggataaagtgggaaaaatgtggaataacttcaaatacaggtgtcagaatctcttcggtcatgagggaggaagccgtagtgaaaatgtggacatgaactccaacagatgtttgtctgtcaaagagaaaaacatcagcataggagactcaactcctcagcaacaaagcagtcccttaagagaaaatattgccttacaactgggattaagcccttcgaagaattcttcaaggagaaatcaaaattgtgccacagaaatccctcaaattgttgaaataagcatcgaaaaggataatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctctctgaattaatgcttgagaaatgcccttttcctgctggctcagatttagcccaaaaatggcatttgattaaacagcatacagctcctgtgagcccacattcaacattttttgatacatttgatccatctttggtttctacagaagatgaagaagataggcttagagagagaaggcgcccagttgttcgagaccagcctggacaacatggcgagatcccatctccacaaaagaaatacaaaactagttgggcatggtggcgtgtgcctccagtcccagctaccagggaggccgaggtgagaagacagatggag

SEQ ID NO: 312168 - DNA, 4052 bp, Homo sapiens
tggtgggggttggggggaggggggaggggaaacgggtgaagaaggggaggcggcagggaagggggtgggggcctggcgggggcatccggcggagctggggtccccgggctccgtccggaggaagcgacgctgcgctcgctgggcagtcggaggggacgggacgcaccggagggcaggcggactcgccctgtcggtgactgcgccgtccgggcccgtcctgcctggccgcaggtgccctggatgaggccgccccgcgcgccccaaacgattttataatcaatggataaagtgggaaaaatgtggaataacttcaaatacaggtgtcagaatctcttcggtcatgagggaggaagccgtagtgaaaatgtggacatgaactccaacagatgtttgtctgtcaaagagaaaaacatcagcataggagactcaactcctcagcaacaaagcagtcccttaagagaaaatattgccttacaactgggattaagcccttcgaagaattcttcaaggagaaatcaaaattgtgccacagaaatccctcaaattgttgaaataagcatcgaaaaggataatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctctctgaattaatgcttgagaaatgcccttttcctgctggctcagatttagcccaaaaatggcatttgattaaacagcatacagctcctgtgagcccacattcaacattttttgatacatttgatccatctttggtttctacagaagatgaagaagataggcttagagagagaaggcggcttagtattgaagaaggggttgatccccctcccaatgcacaaatacatacatttgaagctactgcacaggttaatccattatataaactgggaccaaaattagctcctggaatgactgaaataagtggggacagttctgcaattccacaagctaattgtgactcggaagaggatacaaccaccctgtgtttgcagtcacggaggcagaagcagcgtcagatatctggagacagccatacccatgttagcagacagggagcttggaaagtccacacacagattgattacatacactgcctcgtgcctgatttgcttcaaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcccatgacccgtgtgtatttcactcctccactgtaacgggacttttagaacattataaagatcccagttcgtgcatgttttttgaaccattgcttactatatcactaaataggactttcccttttagcctgcagtatatctgtcgcgcggtaatctgcaggtgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaagggtgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcagttcacttacgtgttgatgtagtttataatcagacgccttttctcttctgcaaaaggtactgttaagtaaaccagattttctaaataggcattcttaaaatttcagacttacaaagctagtagtagaattttattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttatagaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgtatatctgctgttttatacatttgcaacaatttctcttgtaaatggaatggtttggggtttttaaataagcattaactaacaacctttctatagttaatgcagagttaatgaacagtctaatattgacttatcagaataagctaactctaaatttaatgctctacatcttatcagtcataattatatatactgtggaacagtatctgtagttactgcaaattactgtacagtttaggttataacagaaaactgacagagaagtaataaacctattgatttctctgcttataaatgaaagattgaaactatccaatgacatattatagtaaatgagtatctgtaacctcccactgcatcagaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgag

SEQ ID NO: 312169 - DNA, 5577 bp, Homo sapiens
tggtgggggttggggggaggggggaggggaaacgggtgaagaaggggaggcggcggcctggcgggggcatccggcggagctggggtccccgggctccgtccggaggaagcgacgctgcgctcgctgggcagtcggaggggacgggacgcaccggagggcaggcggactcgccctgtcggtgactgcgccgtccgggcccgtcctgcctggccgcaggtgccctggatgaggccgccccgcgcgccccaaacgattttataatcaatggataaagtgggaaaaatgtggaataacttcaaatacaggtgtcagaatctcttcggtcatgagggaggaagccgtagtgaaaatgtggacatgaactccaacagatgtttgtctgtcaaagagaaaaacatcagcataggagactcaactcctcagcaacaaagcagtcccttaagagaaaatattgccttacaactgggattaagcccttcgaagaattcttcaaggagaaatcaaaattgtgccacagaaatccctcaaattgttgaaataagcatcgaaaaggataatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctctctgaattaatgcttgagaaatgcccttttcctgctggctcagatttagcccaaaaatggcatttgattaaacagcatacagctcctgtgagcccacattcaacattttttgatacatttgatccatctttggtttctacagaagatgaagaagataggcttagagagagaaggcggcttagtattgaagaaggggttgatccccctcccaatgcacaaatacatacatttgaagctactgcacaggttaatccattatataaactgggaccaaaattagctcctggaatgactgaaataagtggggacagttctgcaattccacaagctaattgtgactcggaagaggatacaaccaccctgtgtttgcagtcacggaggcagaagcagcgtcagatatctggagacagccatacccatgttagcagacagggagcttggaaagtccacacacagattgattacatacactgcctcgtgcctgatttgcttcaaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcccatgacccgtgtgtatttcactcctccactgtaacgggacttttagaacattataaagatcccagttcgtgcatgttttttgaaccattgcttactatatcactaaataggactttcccttttagcctgcagtatatctgtcgcgcggtaatctgcaggtgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaagggtgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcagttcacttacgtgttgatgtagtttataatcagacgccttttctcttctgcaaaaggtactgttaagtaaaccagattttctaaataggcattcttaaaatttcagacttacaaagctagtagtagaattttattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttatagaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgtatatctgctgttttatacatttgcaacaatttctcttgtaaatggaatggtttggggtttttaaataagcattaactaacaacctttctatagttaatgcagagttaatgaacagtctaatattgacttatcagaataagctaactctaaatttaatgctctacatcttatcagtcataattatatatactgtggaacagtatctgtagttactgcaaattactgtacagtttaggttataacagaaaactgacagagaagtaataaacctattgatttctctgcttataaatgaaagattgaaactatccaatgacatattatagtaaatgagtatctgtaacctcccactgcatcagaagcaggttaaatgaagtcttgtgaatttgtaatagatcagtaccatttattggtttggggaccatcttaattaaaaataaatgcccaaaatgtagaactttaaccaaagacttgtcccttttaaagcaaaatggggattgaagggacttataatttctgttgtttctaattaaagtccctgaagatcatataccaaagtgtttgagaacttcatccaaacctactttaaagcattatgtgcaattaagttgttatgacataattatattgcctaattgttgggtcttttttcttgagcttataatgtacctggaaaataaacctcttgagaaaaagaaaagttcatactgattattggaaaaggactatatatgtgagcaagattgtgttttagagaggaaacttgaaactccaagaaagcacttgatgtttttatatgcttgtagcaaattgatgttctaactgtagttttatagaaagtattaatgcttttatgtatttcaaaactttcatatgttaaatggaaattgttttaaatgtgtttgagtttatgtaagcatgtatacactgtgctaaaagtcacatgtttcagtttgtgtataatattaatatgcaatttttggtttaaatttttgtcttaaaatattagtggcttacattttaaaaaagaaaaatcaccagcatgaacttgcacctaagtctatattcactgtgtccttttctgaatcccattgtagcctgtcaactaaatttgagtgttaacggtctttttaaagtgcatttaaatacaaaccaggaatttctttagaagttgagatacatctttatagttgaaataattaacccaagaaaaggttgctttgatttgtacccattctcattcattttcttcattcccttacacacacacacacacctctcccttccgcatacatataagtgtgtattatatatttatgtatgcacatatatacatttatgttgttaatattactttagatggcatttccacctgatacaaaaacatttagagatcttattctatagatattacctaaagagtattcttgtactattcgaattttattatctgcactaaaagtttagccttgctactttagccttgtttataatacagtcaccttacaaagagaaagagttcatctgtattttgttttctggctaaacacagtacaaaatatttgaagaaaaacagcttggattaaatagttactaagagttataattaaatttatgtttcttagacaaaaaaaaaaaaaaaaaaaaaaaaaaaaaaaaaaaaaaaaaaaaaaaaaaagaaaaaaaaaaaaaaaaaagaacaacaaagaatacaaagaacaaacaaaagcagtacaaactacaggcaaagcagaagaaagagacagccacacgaacgaaacccgcaaacagagacagcagaagaggaaaaacaaaacaagaaacgaacgagaagagacgaacacgagcaagataaaaaaaaagccaaagcgacctacgaagaaccaagaacagaaagagaaagaaaccagatagaaaacaagaacgacgcgagaggagacaaagaaaggataaaagagcaaggagacagaaatgagagagcagccaagcacgcaacgcgcagcgcacaggctccatagacaagaacaaaaagacagaaacggaagaaacgaacagaacaagaaccaacaccgaggaagacaaaaacgagacagaacaggaaggacaagaacgaacgacagagaaaaggaaaaacgaaagaacgaaaagagcacaacgaaagaaaagcaggaacaagaacgacacaagaaaacacaccagaacaaacaaacagaaaagaaggcaaaacaaa

SEQ ID NO: 312170 - DNA, 3525 bp, Homo sapiens
  misc_feature (3500)..(3500): n is a, c, g, or t
  misc_feature (3506)..(3506): n is a, c, g, or t
tggtgggggttggggggaggggggaggggaaacgggtgaagaaggggaggcggcggcctggcgggggcatccggcggagctggggtccccgggctccgtccggaggaagcgacgctgcgctcgctgggcagtcggaggggacgggacgcaccggagggcaggcggactcgccctgtcggtgactgcgccgtccgggcccgtcctgcctggccgcaggtgccctggatgaggccgccccgcgcgccccaaacgattttataatcaatggataaagtgggaaaaatgtggaataacttcaaatacaggtgtcagaatctcttcggtcatgagggaggaagccgtagtgaaaatgtggacatgaactccaacagatgtttgtctgtcaaagagaaaaacatcagcataggagactcaactcctcagcaacaaagcagtcccttaagagaaaatattgccttacaactgggattaagcccttcgaagaattcttcaaggagaaatcaaaattgtgccacagaaatccctcaaattgttgaaataagcatcgaaaaggataatgattcttgtgttaccccaggaacaagacttgcacgaagagattcctactctcgacatgctccatggggtgggaagaaaaaacattcctgttctacaaagacccagagttcattggatgctgataaaaagtttggtagaactcgaagtggacttcaaaggagagagaggcgctacggcgtaagttctgtacacgacatggacagtgtttccagcagaactgtaggaagtcgctctctaagacagaggttgcaggatactgtgggcttgtgttttcccatgagaacttacagcaagcagtcaaagcctctcttttccaataaaagaaaaatccatctctctgaattaatgcttgagaaatgcccttttcctgctggctcagatttagcccaaaaatggcatttgattaaacagcatacagctcctgtgagcccacattcaacattttttgatacatttgatccatctttggtttctacagaagatgaagaagataggcttagagagagaaggcggcttagtattgaagaaggggttgatccccctcccaatgcacaaatacatacatttgaagctactgcacaggttaatccattatataaactgggaccaaaattagctcctggaatgactgaaataagtggggacagttctgcaattccacaagctaattgtgactcggaagaggatacaaccaccctgtgtttgcagtcacggaggcagaagcagcgtcagatatctggagacagccatacccatgttagcagacagggagcttggaaagtccacacacagattgattacatacactgcctcgtgcctgatttgcttcaaattacagggaatccctgttactggggagtgatggaccgttatgaagcagaagcccttctcgaagggaaacctgaaggcacgtttttgctcagggactctgcgcaagaggactacctcttctctgtgagcttccgccgctacaacagatccctgcatgcccgaattgagcagtggaatcacaactttagtttcgacgcccatgacccgtgtgtatttcactcctccactgtaacgggacttttagaacattataaagatcccagttcgtgcatgttttttgaaccattgcttactatatcactaaataggactttcccttttagcctgcagtatatctgtcgcgcggtaatctgcaggtgcactacgtatgatggaattgatgggctccctctaccctcaatgttacaggattttttaaaagagtatcattataaacaaaaagttagagttcgctggttggaacgagaaccagtcaaggcaaagtaaactctccggtccccaaagggtgttaactaggtccgctttcatgtgcatcagacagtacacctatagcaagcacacgtagcagtgttaggctttttcatacagtatgtaagcttagtgttagtatctgtcagatgctacctgctgttacttattcagataaacatggtgcctattggaacaatagcggatagagctacaggtgttcagtaagactacaaaaacattttgcctatttcgctaacagtttggtttttaatggctgtggtatttgagtgaggcaactctggggcatttgttatgaagaattctatttcttactgaagaacaaattattaatattggatgagtatttcaacagtgtgactaatgtttgaaattattttttctaagagtttttctataaccttccaaaagtcgtgatgtttgtagttactataaatcaagctttggaagtccaaaaagaataaaagactgccttccttttagaaaaaaatgcaattttctggccacaagggcatagtgcagttcacttacgtgttgatgtagtttataatcagacgccttttctcttctgcaaaaggtactgttaagtaaaccagattttctaaataggcattcttaaaatttcagacttacaaagctagtagtagaattttattgaaaggcctaggtattaattttttaaatgagtgctttaacttaaaacaggcgtttggaatagctgctgcaatgtagtcttgtgtgtgatttttttttaagttgatgtgcagtctaattgttgtttcataaaagttggatctgttcctatgcccaggatgattttgtgaaccgtgaagtacgtgagactagaagacgcccaaacaagtcagataatagtaactacaatggttgctgatgttgagattattgttgaactataattaataatttggatggcagaatttatctcttttttgtaaactctcataactgaattgcttaagtataatttatagaatttcagtgcagttcattcttaatggaaaatctgaaacctaaattgcagatttaaaaggtactgtacaaccattatatctgtaaataacttagcacctttttgtcacttagaataatatgtactactacttgagtgagcgcttttggaagttatatcaagttctagtgtttgcttcttagtaactgaactgaatttacagttctgtcctagacattttgcactaaagtagccgaatccactctcatgtcttttcgttaatgtgctctgtaccactggtgagtgctccatagtttccttacctgctgctacagaatgttattttacatccctatggctattgccaaggctacaaaaaaggaaagctatatttgtatgcaacactaaccttttgactgctaatgtatgtttctgcttgctgtgccttgttatggctgctttttttgtgctaataaagtatgtttggtgttctccttgtatatctgctgttttatacatttgcaacaatttctcttgtttggtaaattgggaaatgggttttggggggttttttaaaataaagccttttaaccttaacccaacccttttttttttaggttaaatggccgaaaggttaaatggaaccaggccnaaatantttggcctttattccaaaa

SEQ ID NO: 312171 - DNA, 6209 bp, Homo sapiens
ccaccgcctccacctccatcgccgtcgggggaggggccggccggaccccggggtcactgccgaggaatgaagagaggcggccgggccccgcgctccgccccggcctagggccttgccccgggagcccgcgaggtggaggcctgaattttgatctatgttctaccatacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagctacatgaatgtgaagtggatcccactgtcctctgatgcacaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagagagccccctgagccagatggatgggctggaggtctccggggccttcccccaactcagaccaaatgcaaacaaccgaactgcagcttctatggacaccctgagacaaacaacttctgttcctgttgttacagggaagaactgaggaggagggagcgggaaccggatggggagctcctggtgcacaggttctgaacgggtggaacactgaagggcaaggaggctaaacaaagttaagctcaactaattggctcatcaagaacacagtccccatgttgagggggaaaatgcagtaatgtttgtgggagcctggctggaaacttttaagtgtgtgcacacaggagtgctgccaggctggcaagagcaggtcggggctggatggcacctcaggggctgtactattcctctgcagagcttgacttgatgaggtttgaggtacaaggggaaaagatggcgattctgtcttataacctcctgggtcccatccagggacctaagagaaagtagcaggggaaggtttggtgtgtgggggtgggaggtgggcagaagtcttggggaggaatgggcaaaggaggttctcagtcaataaaaccaaagttctttaggttgggaaaaagcacatggtggagtgagaagtgtggaggggaagtgggaaattggacacatttgctattgatttgaattaagctagaaattaaggttggataaattcttccccttgaaggatctggaaagacaaggcagtaatgtgtcctcatgggtgcctgttaggaggtgggggtagtttaaatccgtttgtttagatgggaaagggaggaacttaagagggaaatccttttcctcttaaggtttatttccttccaagcagtcatatgtcatctgttacagtttgagaagagattgctgattaccccctgtcttttcctcatctaagtctttaattgtatttgtttaaagggaagagtgtggtgagaacagccgtcatgtgtgttgcattttctccaggtgaattggggcagagctgatctattttttaaccacagcaataaccatacgttggggtttgagtgcaccttgggaggggtgggaggacagacattttagccagaggctgtttcaaacaaaaccaaaaacctaagtagagcattacaggcctctgtggctgctgcgtttctgtagaaagcaacttattttattgacttttttttttaaggaaaagaaataaaaagaccccagcaagcaaaaacatttaaaaaatgattttttttcctcctacttaagtggttctttctccctttgctctacttttggagaatgaacttaacatcccggcttcttttgttaagccatagctgaccttaatctgtggttagtttattaaaataattaaaaatactttctaagaagagatatttttgatattaggactgatgttgaaacatataggggcaatttataaaaaggtagttagagaaatatattttagtgaactataaccacagagcacagatgactcccaatgagctgatctgtctttaggtttctccctttccctgacccttccctgttctctaggggctgggagtggggatgcggacacagtagggggagctccttcgcattttgcacaaagcacaagtctgaacagcctatgctctggccagagccatttctaagagctttaaaccggaagacctatcctgggccaattttcctttttctttatatttttttccgggaaaaaaagtcaactatgcaattgtatacactcccgggtgcatgtgaagaaggggaataagtgtacttatgtgtccagagtattaactggggctgtttttctgtgtttggatttctcttttgaggtatgtactcataacccatcccttggaacgtaatccccacatttgatctaaagcacttgagcgtgcatgcatgtgcgtgcgtgcatatgtgtgtgtgttttcctcctcggtagccagtcaagattgtccttgttggaaatgctcacggtttataaaggttattttctcctcaacaaactcagaagtcacctattttccaaatctgatttaataatttcctatggctattaattcttagggttttctttgaaaatagatttgtgttaaggaagcagtgagattccaaaggaagggatgtgtatatgtctaggcaggtctggaacctggtatgagatgagcactcccctaagttgcaaaatttaagggttactataaaactcattaatcaagatactataaaaaatgcagtatttaaaaaaattaatgcaaaaaatttatgttggataaaatagcgaaatcttacaggatctgacaggactgagattaggaggagggaagtgaggctgaattgaataagtatggggatgaatccttcttatttaaatttttgatacattgtccatcatagactttttacattaattgtgattttttaaaaatgttgcattaaaatagtatttatcttggttactgggttttttggcactccttaaattttgtgcccaaggtgagtgctttgctcacctcaccctagttacgtccctgtttctgtgatttgaacactagcgagaacaccactgtgtgcgcctccacccccatcacacaccaaacaacaggtggctcagacaccctgaatttgcacagctcacctagctttcctaatttaggccttcatatcatagaatggtggcctggaccaataggaatgaaaacagaccaggggttttcccagagaataaagccggaaaagttttgattctccactggactgctgtgtttggatttgatctgttgttagattctagttaacacttttgtttttaaaaactaaggacaaatgaacaaaaaaccttgtatcatgtttgtttttatttataagttagccaatcccaattccgtttgctttattttcaaataaaaaaagatggaaattttgaggggtggtctaggggtgaatatggtaaaatggggctttaggccttatagctttttattaagaaataaattattttttttatttgggagggtaactatttattgaggcattgaagagatagtgaagtttgttttgcttcattctttcggggagggtcttggtgggatggggggaggtgaaggaataatgcctgggaaattaatatagattcagcttggtttgtggtattttgggaagatgagggaatagaagaggcaagcccatgtcgttactgggttggggagaaggaaagaaggggcatatggcctgcactcgaaatgggcagaaaaattccttagttaaggaggggtgtgtgagtgaagggggaaggtagaccctttaaccccaagtgagggatgatatcatctctcaggcttaaatttaagtgcacttagttcctttaatccagggcaactggggtacctactgaagtttttaatggagaggggagattttcagggttcttgtttttccctttttgatgttagacagtgctactccctccctgctgtgctctctgccccatctccaatggagtaagtattactgtaggataggcctccgcttctcccttaacctatgctgcatttattgaaagttacaagatttaaccagaagtttttcctccatactggtttttatcaacaaaataaaaagattatatccaaaaaaattt

SEQ ID NO: 312172 - DNA, 6214 bp, Homo sapiens
gggcaaaaagccactgggggaggccagtcccgatcagtcctttctggctccagctccagatcccgtgcggagcaacagctgcggtggaggcctgaattttgatctatgttctaccatacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagctacatgaatgtgaagtggatcccactgtcctctgatgcacaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagagagccccctgagccagatggatgggctggaggtctccggggccttcccccaactcagaccaaatgcaaacaaccgaactgcagcttctatggacaccctgagacaaacaacttctgttcctgttgttacagggaagaactgaggaggagggagcgggaaccggatggggagctcctggtgcacaggttctgaacgggtggaacactgaagggcaaggaggctaaacaaagttaagctcaactaattggctcatcaagaacacagtccccatgttgagggggaaaatgcagtaatgtttgtgggagcctggctggaaacttttaagtgtgtgcacacaggagtgctgccaggctggcaagagcaggtcggggctggatggcacctcaggggctgtactattcctctgcagagcttgacttgatgaggtttgaggtacaaggggaaaagatggcgattctgtcttataacctcctgggtcccatccagggacctaagagaaagtagcaggggaaggtttggtgtgtgggggtgggaggtgggcagaagtcttggggaggaatgggcaaaggaggttctcagtcaataaaaccaaagttctttaggttgggaaaaagcacatggtggagtgagaagtgtggaggggaagtgggaaattggacacatttgctattgatttgaattaagctagaaattaaggttggataaattcttccccttgaaggatctggaaagacaaggcagtaatgtgtcctcatgggtgcctgttaggaggtgggggtagtttaaatccgtttgtttagatgggaaagggaggaacttaagagggaaatccttttcctcttaaggtttatttccttccaagcagtcatatgtcatctgttacagtttgagaagagattgctgattaccccctgtcttttcctcatctaagtctttaattgtatttgtttaaagggaagagtgtggtgagaacagccgtcatgtgtgttgcattttctccaggtgaattggggcagagctgatctattttttaaccacagcaataaccatacgttggggtttgagtgcaccttgggaggggtgggaggacagacattttagccagaggctgtttcaaacaaaaccaaaaacctaagtagagcattacaggcctctgtggctgctgcgtttctgtagaaagcaacttattttattgacttttttttttaaggaaaagaaataaaaagaccccagcaagcaaaaacatttaaaaaatgattttttttcctcctacttaagtggttctttctccctttgctctacttttggagaatgaacttaacatcccggcttcttttgttaagccatagctgaccttaatctgtggttagtttattaaaataattaaaaatactttctaagaagagatatttttgatattaggactgatgttgaaacatataggggcaatttataaaaaggtagttagagaaatatattttagtgaactataaccacagagcacagatgactcccaatgagctgatctgtctttaggtttctccctttccctgacccttccctgttctctaggggctgggagtggggatgcggacacagtagggggagctccttcgcattttgcacaaagcacaagtctgaacagcctatgctctggccagagccatttctaagagctttaaaccggaagacctatcctgggccaattttcctttttctttatatttttttccgggaaaaaaagtcaactatgcaattgtatacactcccgggtgcatgtgaagaaggggaataagtgtacttatgtgtccagagtattaactggggctgtttttctgtgtttggatttctcttttgaggtatgtactcataacccatcccttggaacgtaatccccacatttgatctaaagcacttgagcgtgcatgcatgtgcgtgcgtgcatatgtgtgtgtgttttcctcctcggtagccagtcaagattgtccttgttggaaatgctcacggtttataaaggttattttctcctcaacaaactcagaagtcacctattttccaaatctgatttaataatttcctatggctattaattcttagggttttctttgaaaatagatttgtgttaaggaagcagtgagattccaaaggaagggatgtgtatatgtctaggcaggtctggaacctggtatgagatgagcactcccctaagttgcaaaatttaagggttactataaaactcattaatcaagatactataaaaaatgcagtatttaaaaaaattaatgcaaaaaatttatgttggataaaatagcgaaatcttacaggatctgacaggactgagattaggaggagggaagtgaggctgaattgaataagtatggggatgaatccttcttatttaaatttttgatacattgtccatcatagactttttacattaattgtgattttttaaaaatgttgcattaaaatagtatttatcttggttactgggttttttggcactccttaaattttgtgcccaaggtgagtgctttgctcacctcaccctagttacgtccctgtttctgtgatttgaacactagcgagaacaccactgtgtgcgcctccacccccatcacacaccaaacaacaggtggctcagacaccctgaatttgcacagctcacctagctttcctaatttaggccttcatatcatagaatggtggcctggaccaataggaatgaaaacagaccaggggttttcccagagaataaagccggaaaagttttgattctccactggactgctgtgtttggatttgatctgttgttagattctagttaacacttttgtttttaaaaactaaggacaaatgaacaaaaaaccttgtatcatgtttgtttttatttataagttagccaatcccaattccgtttgctttattttcaaataaaaaaagatggaaattttgaggggtggtctaggggtgaatatggtaaaatggggctttaggccttatagctttttattaagaaataaattattttttttatttgggagggtaactatttattgaggcattgaaaaacctctccattctaaggatgagagaccctgagacaatggatattttttataggagatagtgaagtttgttttgcttcattctttcggggagggtcttggtgggatggggggaggtgaaggaataatgcctgggaaattaatatagattcagcttggtttgtggtattttgggaagatgagggaatagaagaggcaagcccatgtcgttactgggttggggagaaggaaagaaggggcatatggcctgcactcgaaatgggcagaaaaattccttagttaaggaggggtgtgtgagtgaagggggaaggtagaccctttaaccccaagtgagggatgatatcatctctcaggcttaaatttaagtgcacttagttcctttaatccagggcaactggggtacctactgaagtttttaatggagaggggagattttcagggttcttgtttttccctttttgatgttagacagtgctactccctccctgctgtgctctctgccccatctccaatggagtaagtattactgtaggataggcctccgcttctcccttaacctatgctgcatttattgaaagttacaagatttaaccagaagtttttcctccatactggtttttatcaacaaaataaaaagattatatccaaaaaaattt

SEQ ID NO: 312173 - DNA, 5526 bp, Homo sapiens
gggcaaaaagccactgggggaggccagtcccgatcagtcctttctggctccagctccagatcccgtgcggagcaacagctgcggtggaggcctgaattttgatctatgttctaccatacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagctacatgaatgtgaagtggatcccactgtcctctgatgcacaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagaagtcttggggaggaatgggcaaaggaggttctcagtcaataaaaccaaagttctttaggttgggaaaaagcacatggtggagtgagaagtgtggaggggaagtgggaaattggacacatttgctattgatttgaattaagctagaaattaaggttggataaattcttccccttgaaggatctggaaagacaaggcagtaatgtgtcctcatgggtgcctgttaggaggtgggggtagtttaaatccgtttgtttagatgggaaagggaggaacttaagagggaaatccttttcctcttaaggtttatttccttccaagcagtcatatgtcatctgttacagtttgagaagagattgctgattaccccctgtcttttcctcatctaagtctttaattgtatttgtttaaagggaagagtgtggtgagaacagccgtcatgtgtgttgcattttctccaggtgaattggggcagagctgatctattttttaaccacagcaataaccatacgttggggtttgagtgcaccttgggaggggtgggaggacagacattttagccagaggctgtttcaaacaaaaccaaaaacctaagtagagcattacaggcctctgtggctgctgcgtttctgtagaaagcaacttattttattgacttttttttttaaggaaaagaaataaaaagaccccagcaagcaaaaacatttaaaaaatgattttttttcctcctacttaagtggttctttctccctttgctctacttttggagaatgaacttaacatcccggcttcttttgttaagccatagctgaccttaatctgtggttagtttattaaaataattaaaaatactttctaagaagagatatttttgatattaggactgatgttgaaacatataggggcaatttataaaaaggtagttagagaaatatattttagtgaactataaccacagagcacagatgactcccaatgagctgatctgtctttaggtttctccctttccctgacccttccctgttctctaggggctgggagtggggatgcggacacagtagggggagctccttcgcattttgcacaaagcacaagtctgaacagcctatgctctggccagagccatttctaagagctttaaaccggaagacctatcctgggccaattttcctttttctttatatttttttccgggaaaaaaagtcaactatgcaattgtatacactcccgggtgcatgtgaagaaggggaataagtgtacttatgtgtccagagtattaactggggctgtttttctgtgtttggatttctcttttgaggtatgtactcataacccatcccttggaacgtaatccccacatttgatctaaagcacttgagcgtgcatgcatgtgcgtgcgtgcatatgtgtgtgtgttttcctcctcggtagccagtcaagattgtccttgttggaaatgctcacggtttataaaggttattttctcctcaacaaactcagaagtcacctattttccaaatctgatttaataatttcctatggctattaattcttagggttttctttgaaaatagatttgtgttaaggaagcagtgagattccaaaggaagggatgtgtatatgtctaggcaggtctggaacctggtatgagatgagcactcccctaagttgcaaaatttaagggttactataaaactcattaatcaagatactataaaaaatgcagtatttaaaaaaattaatgcaaaaaatttatgttggataaaatagcgaaatcttacaggatctgacaggactgagattaggaggagggaagtgaggctgaattgaataagtatggggatgaatccttcttatttaaatttttgatacattgtccatcatagactttttacattaattgtgattttttaaaaatgttgcattaaaatagtatttatcttggttactgggttttttggcactccttaaattttgtgcccaaggtgagtgctttgctcacctcaccctagttacgtccctgtttctgtgatttgaacactagcgagaacaccactgtgtgcgcctccacccccatcacacaccaaacaacaggtggctcagacaccctgaatttgcacagctcacctagctttcctaatttaggccttcatatcatagaatggtggcctggaccaataggaatgaaaacagaccaggggttttcccagagaataaagccggaaaagttttgattctccactggactgctgtgtttggatttgatctgttgttagattctagttaacacttttgtttttaaaaactaaggacaaatgaacaaaaaaccttgtatcatgtttgtttttatttataagttagccaatcccaattccgtttgctttattttcaaataaaaaaagatggaaattttgaggggtggtctaggggtgaatatggtaaaatggggctttaggccttatagctttttattaagaaataaattattttttttatttgggagggtaactatttattgaggcattgaaaaacctctccattctaaggatgagagaccctgagacaatggatattttttataggagatagtgaagtttgttttgcttcattctttcggggagggtcttggtgggatggggggaggtgaaggaataatgcctgggaaattaatatagattcagcttggtttgtggtattttgggaagatgagggaatagaagaggcaagcccatgtcgttactgggttggggagaaggaaagaaggggcatatggcctgcactcgaaatgggcagaaaaattccttagttaaggaggggtgtgtgagtgaagggggaaggtagaccctttaaccccaagtgagggatgatatcatctctcaggcttaaatttaagtgcacttagttcctttaatccagggcaactggggtacctactgaagtttttaatggagaggggagattttcagggttcttgtttttccctttttgatgttagacagtgctactccctccctgctgtgctctctgccccatctccaatggagtaagtattactgtaggataggcctccgcttctcccttaacctatgctgcatttattgaaagttacaagatttaaccagaagtttttcctccatactggtttttatcaacaaaataaaaagattatatccaaaaaaattt

SEQ ID NO: 312174 - DNA, 3098 bp, Homo sapiens
gggcaaaaagccactgggggaggccagtcccgatcagtcctttctggctccagctccagatcccgtgcggagcaacagctgcggtggaggcctgaattttgatctatgttctaccatacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagctacatgaatgtgaagtggatcccactgtcctctgatgcacaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagagagccccctgagccagatggatgggctggaggtctccggggccttcccccaactcagaccaaatgcaaacaaccgaactgcagcttctatggacaccctgagacaaacaacttctgttcctgttgttacagggaagaactgaggaggagggagcgggaaccggatggggagctcctggtgcacaggttctgaacgggtggaacactgaagggcaaggaggctaaacaaagttaagctcaactaattggctcatcaagaacacagtccccatgttgagggggaaaatgcagtaatgtttgtgggagcctggctggaaacttttaagtgtgtgcacacaggagtgctgccaggctggcaagagcaggtcggggctggatggcacctcaggggctgtactattcctctgcagagcttgacttgatgaggtttgaggtacaaggggaaaagatggcgattctgtcttataacctcctgggtcccatccagggacctaagagaaagtagcaggggaaggtttggtgtgtgggggtgggaggtgggcagaagtcttggggaggaatgggcaaaggaggttctcagtcaataaaaccaaagttctttaggttggg

SEQ ID NO: 312175 - DNA, 454 bp, Homo sapiens
gcagttgggattagttgacagggcttcttaggaaagaattattaaacatgttggaatgaaagcagggagggactcacttggcagagtgggatgtagggattgtccactaggcagaaacacagccttcataataatcttcatggcttcctgcagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaaggtgctgaatgacatgtcttttggtctgcattattttcacttgaaaaaattgaatgagatctaatgtaggaggaaagaattaagtgacatgcaagcccagacagcacatgttgatactgttttattaagccagaagttacgccagagttttc

SEQ ID NO: 312176 - DNA, 612 bp, Homo sapiens
aggtaggtgaaatgttatgtggcaggtgggtgagcaggatggagggcagaaatgggacagattgcagtaggtcaaaaagaatggatgataaagaagtttaatagtcatagactattagttcatggatcttgactgtaaaagagataagagatttgactttgtagtacaatttgtaaaccaagtgctaagggattagggagtaagtaacagtgaataaggtggaataggtattgcctcttagaacccagcctctaattgcccaatgtcccctgcctgtccttcacacagtcagggctggtatacacagaagatgaatggcagaaggagtggaatgaactgatcaagcttgcctcaagtgaaccccgaatgcatctaggtaccaatggagccaactgtggtgggtaagtatggctaagtaggggaggaggaaacctgcatagagtcctcactgggcttccacagcccagtgtctagagagctctgtgctaagaggatattagaaggaaagaggggaactatgctaagggcacaaaagtgtgtaacaacatgatatgtttaggaactacaggtagttcggtattgaactggaatataaagtagcccatctagact

SEQ ID NO: 312177 - DNA, 363 bp, Homo sapiens
tcactgatctaaccaattgtgctcacaagattctgactgactagatataagtgaggaagatataaagagtaatcaagtgatggttttattctgggtaggcctcctagaggaggctgctttggagtctgtttcagaaataggaaggtggaagggcttcatggataatctccttttcctccactatcttgtttctacagggcgtttgaactggtgggtgagtgtggatcccacctctcagaggctgcttcctttggcaactactggagatgggaactgcctcctgcatgcagcctcccttggtgagtcttgaaagcagtcctccattcacctgcagaaaggaagcagttgagtcaaatctcatgt

SEQ ID NO: 312178 - DNA, 6263 bp, Homo sapiens
ccaccgcctccacctccatcgccgtcgggggaggggccggccggaccccggggtcactgccgaggaatgaagagaggcggccgggccccgcgctccgccccggcctagggccttgccccgggagcccgcgaggtggaggcctgaattttgatctatgttctaccatacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagctacatgaatgtgaagtggatcccactgtcctctgatgcacaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagagagccccctgagccagatggatgggctggaggtctccggggccttcccccaactcagaccaaatgcaaacaaccgaactgcagcttctatggacaccctgagacaaacaacttctgttcctgttgttacagggaagaactgaggaggagggagcgggaaccggatggggagctcctggtgcacaggttctgaacgggtggaacactgaagggcaaggaggctaaacaaagttaagctcaactaattggctcatcaagaacacagtccccatgttgagggggaaaatgcagtaatgtttgtgggagcctggctggaaacttttaagtgtgtgcacacaggagtgctgccaggctggcaagagcaggtcggggctggatggcacctcaggggctgtactattcctctgcagagcttgacttgatgaggtttgaggtacaaggggaaaagatggcgattctgtcttataacctcctgggtcccatccagggacctaagagaaagtagcaggggaaggtttggtgtgtgggggtgggaggtgggcagaagtcttggggaggaatgggcaaaggaggttctcagtcaataaaaccaaagttctttaggttgggaaaaagcacatggtggagtgagaagtgtggaggggaagtgggaaattggacacatttgctattgatttgaattaagctagaaattaaggttggataaattcttccccttgaaggatctggaaagacaaggcagtaatgtgtcctcatgggtgcctgttaggaggtgggggtagtttaaatccgtttgtttagatgggaaagggaggaacttaagagggaaatccttttcctcttaaggtttatttccttccaagcagtcatatgtcatctgttacagtttgagaagagattgctgattaccccctgtcttttcctcatctaagtctttaattgtatttgtttaaagggaagagtgtggtgagaacagccgtcatgtgtgttgcattttctccaggtgaattggggcagagctgatctattttttaaccacagcaataaccatacgttggggtttgagtgcaccttgggaggggtgggaggacagacattttagccagaggctgtttcaaacaaaaccaaaaacctaagtagagcattacaggcctctgtggctgctgcgtttctgtagaaagcaacttattttattgacttttttttttaaggaaaagaaataaaaagaccccagcaagcaaaaacatttaaaaaatgattttttttcctcctacttaagtggttctttctccctttgctctacttttggagaatgaacttaacatcccggcttcttttgttaagccatagctgaccttaatctgtggttagtttattaaaataattaaaaatactttctaagaagagatatttttgatattaggactgatgttgaaacatataggggcaatttataaaaaggtagttagagaaatatattttagtgaactataaccacagagcacagatgactcccaatgagctgatctgtctttaggtttctccctttccctgacccttccctgttctctaggggctgggagtggggatgcggacacagtagggggagctccttcgcattttgcacaaagcacaagtctgaacagcctatgctctggccagagccatttctaagagctttaaaccggaagacctatcctgggccaattttcctttttctttatatttttttccgggaaaaaaagtcaactatgcaattgtatacactcccgggtgcatgtgaagaaggggaataagtgtacttatgtgtccagagtattaactggggctgtttttctgtgtttggatttctcttttgaggtatgtactcataacccatcccttggaacgtaatccccacatttgatctaaagcacttgagcgtgcatgcatgtgcgtgcgtgcatatgtgtgtgtgttttcctcctcggtagccagtcaagattgtccttgttggaaatgctcacggtttataaaggttattttctcctcaacaaactcagaagtcacctattttccaaatctgatttaataatttcctatggctattaattcttagggttttctttgaaaatagatttgtgttaaggaagcagtgagattccaaaggaagggatgtgtatatgtctaggcaggtctggaacctggtatgagatgagcactcccctaagttgcaaaatttaagggttactataaaactcattaatcaagatactataaaaaatgcagtatttaaaaaaattaatgcaaaaaatttatgttggataaaatagcgaaatcttacaggatctgacaggactgagattaggaggagggaagtgaggctgaattgaataagtatggggatgaatccttcttatttaaatttttgatacattgtccatcatagactttttacattaattgtgattttttaaaaatgttgcattaaaatagtatttatcttggttactgggttttttggcactccttaaattttgtgcccaaggtgagtgctttgctcacctcaccctagttacgtccctgtttctgtgatttgaacactagcgagaacaccactgtgtgcgcctccacccccatcacacaccaaacaacaggtggctcagacaccctgaatttgcacagctcacctagctttcctaatttaggccttcatatcatagaatggtggcctggaccaataggaatgaaaacagaccaggggttttcccagagaataaagccggaaaagttttgattctccactggactgctgtgtttggatttgatctgttgttagattctagttaacacttttgtttttaaaaactaaggacaaatgaacaaaaaaccttgtatcatgtttgtttttatttataagttagccaatcccaattccgtttgctttattttcaaataaaaaaagatggaaattttgaggggtggtctaggggtgaatatggtaaaatggggctttaggccttatagctttttattaagaaataaattattttttttatttgggagggtaactatttattgaggcattgaaaaacctctccattctaaggatgagagaccctgagacaatggatattttttataggagatagtgaagtttgttttgcttcattctttcggggagggtcttggtgggatggggggaggtgaaggaataatgcctgggaaattaatatagattcagcttggtttgtggtattttgggaagatgagggaatagaagaggcaagcccatgtcgttactgggttggggagaaggaaagaaggggcatatggcctgcactcgaaatgggcagaaaaattccttagttaaggaggggtgtgtgagtgaagggggaaggtagaccctttaaccccaagtgagggatgatatcatctctcaggcttaaatttaagtgcacttagttcctttaatccagggcaactggggtacctactgaagtttttaatggagaggggagattttcagggttcttgtttttccctttttgatgttagacagtgctactccctccctgctgtgctctctgccccatctccaatggagtaagtattactgtaggataggcctccgcttctcccttaacctatgctgcatttattgaaagttacaagatttaaccagaagtttttcctccatactggtttttatcaacaaaataaaaagattatatccaaaaaaattt

SEQ ID NO: 312179 - DNA, 5493 bp, Homo sapiens
gaggtatcttaccattatgcttttttgccacaggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagctacatgaatgtgaagtggatcccactgtcctctgatgcacaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagagagccccctgagccagatggatgggctggaggtctccggggccttcccccaactcagaccaaatgcaaacaaccgaactgcagcttctatggacaccctgagacaaacaacttctgttcctgttgttacagggaagaactgaggaggagggagcgggaaccggatggggagctcctggtgcacaggttctgaacgggtggaacactgaagggcaaggaggctaaacaaagttaagctcaactaattggctcatcaagaacacagtccccatgttgagggggaaaatgcagtaatgtttgtgggagcctggctggaaacttttaagtgtgtgcacacaggagtgctgccaggctggcaagagcaggtcggggctggatggcacctcaggggctgtactattcctctgcagagcttgacttgatgaggtttgaggtacaaggggaaaagatggcgattctgtcttataacctcctgggtcccatccagggacctaagagaaagtagcaggggaaggtttggtgtgtgggggtgggaggtgggcagaagtcttggggaggaatgggcaaaggaggttctcagtcaataaaaccaaagttctttaggttgggaaaaagcacatggtggagtgagaagtgtggaggggaagtgggaaattggacacatttgctattgatttgaattaagctagaaattaaggttggataaattcttccccttgaaggatctggaaagacaaggcagtaatgtgtcctcatgggtgcctgttaggaggtgggggtagtttaaatccgtttgtttagatgggaaagggaggaacttaagagggaaatccttttcctcttaaggtttatttccttccaagcagtcatatgtcatctgttacagtttgagaagagattgctgattaccccctgtcttttcctcatctaagtctttaattgtatttgtttaaagggaagagtgtggtgagaacagccgtcatgtgtgttgcattttctccaggtgaattggggcagagctgatctattttttaaccacagcaataaccatacgttggggtttgagtgcaccttgggaggggtgggaggacagacattttagccagaggctgtttcaaacaaaaccaaaaacctaagtagagcattacaggcctctgtggctgctgcgtttctgtagaaagcaacttattttattgacttttttttttaaggaaaagaaataaaaagaccccagcaagcaaaaacatttaaaaaatgattttttttcctcctacttaagtggttctttctccctttgctctacttttggagaatgaacttaacatcccggcttcttttgttaagccatagctgaccttaatctgtggttagtttattaaaataattaaaaatactttctaagaagagatatttttgatattaggactgatgttgaaacatataggggcaatttataaaaaggtagttagagaaatatattttagtgaactataaccacagagcacagatgactcccaatgagctgatctgtctttaggtttctccctttccctgacccttccctgttctctaggggctgggagtggggatgcggacacagtagggggagctccttcgcattttgcacaaagcacaagtctgaacagcctatgctctggccagagccatttctaagagctttaaaccggaagacctatcctgggccaattttcctttttctttatatttttttccgggaaaaaaagtcaactatgcaattgtatacactcccgggtgcatgtgaagaaggggaataagtgtacttatgtgtccagagtattaactggggctgtttttctgtgtttggatttctcttttgaggtatgtactcataacccatcccttggaacgtaatccccacatttgatctaaagcacttgagcgtgcatgcatgtgcgtgcgtgcatatgtgtgtgtgttttcctcctcggtagccagtcaagattgtccttgttggaaatgctcacggtttataaaggttattttctcctcaacaaactcagaagtcacctattttccaaatctgatttaataatttcctatggctattaattcttagggttttctttgaaaatagatttgtgttaaggaagcagtgagattccaaaggaagggatgtgtatatgtctaggcaggtctggaacctggtatgagatgagcactcccctaagttgcaaaatttaagggttactataaaactcattaatcaagatactataaaaaatgcagtatttaaaaaaattaatgcaaaaaatttatgttggataaaatagcgaaatcttacaggatctgacaggactgagattaggaggagggaagtgaggctgaattgaataagtatggggatgaatccttcttatttaaatttttgatacattgtccatcatagactttttacattaattgtgattttttaaaaatgttgcattaaaatagtatttatcttggttactgggttttttggcactccttaaattttgtgcccaaggtgagtgctttgctcacctcaccctagttacgtccctgtttctgtgatttgaacactagcgagaacaccactgtgtgcgcctccacccccatcacacaccaaacaacaggtggctcagacaccctgaatttgcacagctcacctagctttcctaatttaggccttcatatcatagaatggtggcctggaccaataggaatgaaaacagaccaggggttttcccagagaataaagccggaaaagttttgattctccactggactgctgtgtttggatttgatctgttgttagattctagttaacacttttgtttttaaaaactaaggacaaatgaacaaaaaaccttgtatcatgtttgtttttatttataagttagccaatcccaattccgtttgctttattttcaaataaaaaaagatggaaattttgaggggtggtctaggggtgaatatggtaaaatggggctttaggccttatagctttttattaagaaataaattattttttttatttgggagggtaactatttattgaggcattgaaaaacctctccattctaaggatgagagaccctgagacaatggatattttttataggagatagtgaagtttgttttgcttcattctttcggggagggtcttggtgggatggggggaggtgaaggaataatgcctgggaaattaatatagattcagcttggtttgtggtattttgggaagatgagggaatagaagaggcaagcccatgtcgttactgggttggggagaaggaaagaaggggcatatggcctgcactcgaaatgggcagaaaaattccttagttaaggaggggtgtgtgagtgaagggggaaggtagaccctttaaccccaagtgagggatgatatcatctctcaggcttaaatttaagtgcacttagttcctttaatccagggcaactggggtacctactgaagtttttaatggagaggggagattttcagggttcttgtttttccctttttgatgttagacagtgctactccctccctgctgtgctctctgccccatctccaatggagtaagtattactgtaggataggcctccgcttctcccttaacctatgctgcatttattgaaagttacaagatttaaccagaagtttttcctccatactggtttttatcaacaaaataaaaagattatatccaaaaaaattt

SEQ ID NO: 312180 - DNA, 4659 bp, Homo sapiens
ccaccgcctccacctccatcgccgtcgggggaggggccggccggaccccggggtcactgccgaggaatgaagagaggcggccgggccccgcgctccgccccggcctagggccttgccccgggagcccgcgaggtggaggcctgaattttgatctatgttctaccatacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggaatgtggggtttccatgatcgggacttgatgctgcggaaagctttgtatgcactgatggagaagggagttgagaaggaagcgttgaaaaggcgctggaggtggcagcagacacagcagaataaagagtcagggctggtatacacagaagatgaatggcagaaggagtggaatgaactgatcaagcttgcctcaagtgaaccccgaatgcatctaggtaccaatggagccaactgtggtggggtggagagttctgaggagcctgtatatgagagccttgaagagtttcacgtctttgtccttgctcatgtgcttaggaggcccatagtcgtcgtggcagacaccatgctgagggactccggaggggaagcatttgcccctattccctttggaggaatctatctgcctttggaggtcccagccagccagtgtcaccgctcccctctggtgctcgcctatgatcaggcccacttttctgcactcgtgtccatggagcagaaggagaataccaaggaacaagctgtgatcccacttacagattcagagtataagctgctgcccttgcactttgctgtggaccctggaaagggctgggagtggggcaaagatgatagtgacaatgtccgattggccagtgtaattctgtccctagaggtcaaattgcatctgctgcatagctacatgaatgtgaagtggatcccactgtcctctgatgcacaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagagagccccctgagccagatggatgggctggaggtctccggggccttcccccaactcagaccaaatgcaaacaaccgaactgcagcttctatggacaccctgagacaaacaacttctgttcctgttgttacagggaagaactgaggaggagggagcgggaaccggatggggagctcctggtgcacaggttctgaacgggtggaacactgaagggcaaggaggctaaacaaagttaagctcaactaattggctcatcaagaacacagtccccatgttgagggggaaaatgcagtaatgtttgtgggagcctggctggaaacttttaagtgtgtgcacacaggagtgctgccaggctggcaagagcaggtcggggctggatggcacctcaggggctgtactattcctctgcagagcttgacttgatgaggtttgaggtacaaggggaaaagatggcgattctgtcttataacctcctgggtcccatccagggacctaagagaaagtagcaggggaaggtttggtgtgtgggggtgggaggtgggcagaagtcttggggaggaatgggcaaaggaggttctcagtcaataaaaccaaagttctttaggttgggaaaaagcacatggtggagtgagaagtgtggaggggaagtgggaaattggacacatttgctattgatttgaattaagctagaaattaaggttggataaattcttccccttgaaggatctggaaagacaaggcagtaatgtgtcctcatgggtgcctgttaggaggtgggggtagtttaaatccgtttgtttagatgggaaagggaggaacttaagagggaaatccttttcctcttaaggtttatttccttccaagcagtcatatgtcatctgttacagtttgagaagagattgctgattaccccctgtcttttcctcatctaagtctttaattgtatttgtttaaagggaagagtgtggtgagaacagccgtcatgtgtgttgcattttctccaggtgaattggggcagagctgatctattttttaaccacagcaataaccatacgttggggtttgagtgcaccttgggaggggtgggaggacagacattttagccagaggctgtttcaaacaaaaccaaaaacctaagtagagcattacaggcctctgtggctgctgcgtttctgtagaaagcaacttattttattgacttttttttttaaggaaaagaaataaaaagaccccagcaagcaaaaacatttaaaaaatgattttttttcctcctacttaagtggttctttctccctttgctctacttttggagaatgaacttaacatcccggcttcttttgttaagccatagctgaccttaatctgtggttagtttattaaaataattaaaaatactttctaagaagagatatttttgatattaggactgatgttgaaacatataggggcaatttataaaaaggtagttagagaaatatattttagtgaactataaccacagagcacagatgactcccaatgagctgatctgtctttaggtttctccctttccctgacccttccctgttctctaggggctgggagtggggatgcggacacagtagggggagctccttcgcattttgcacaaagcacaagtctgaacagcctatgctctggccagagccatttctaagagctttaaaccggaagacctatcctgggccaattttcctttttctttatatttttttccgggaaaaaaagtcaactatgcaattgtatacactcccgggtgcatgtgaagaaggggaataagtgtacttatgtgtccagagtattaactggggctgtttttctgtgtttggatttctcttttgaggtatgtactcataacccatcccttggaacgtaatccccacatttgatctaaagcacttgagcgtgcatgcatgtgcgtgcgtgcatatgtgtgtgtgttttcctcctcggtagccagtcaagattgtccttgttggaaatgctcacggtttattctctggacacataagtacacttattccccttcttcacatgcacccgggagtgtattcaattgcatagttgactttttttcccggaaaaaaatattaatataaaggag

SEQ ID NO: 312181 - DNA, 836 bp, Homo sapiens
gggcaaaaagccactgggggaggccagtcccgatcagtcctttctggctccagctccagatcccgtgcggagcaacagctgcggtggaggcctgaattttgatctatgttctaccatacatccagctggctgaaagtacttgaggatcacatgaccctggacatggatgctgttctgtcagattttgtccgttccacaggagcagagccagggctagcgcgagatctcctagaaggaaagaattgggatgtgaatgccgccctcagtgattttgaacagctacgtcaagtccatgctggaaacctacccccatcctttagtgaggggagtggtggctccaggacccctgaaaaagggttttctgacagagagcctactcgccctccccgacccatcctccagcggcaggatgacatcgttcaagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcagggcgtttgaactggtgggtgagtgtggatcccacctctcagaggctgcttcctttggcaactactggagatgggaactgcctcctgcatgcagcctcccttggtgagtcttgaaagcagtcctccattcacctgcagaaaggaagcagttgagtcaaatctcatgtgtaggacttgatccagat

SEQ ID NO: 312182 - DNA, 2355 bp, Homo sapiens
  misc_feature (851)..(851): n is a, c, g, or t
  misc_feature (1294)..(1294): n is a, c, g, or t
  misc_feature (1796)..(1796): n is a, c, g, or t
aatatttatgtatatttatgtgtgtgtgggataagtgtggatatgtttatacatactcatatgtatgtttgtgtgtgtatctgtctgtgcctgcctccattttcttttgctttagagaggctatacttgaggctgccatcaagagtgagaagtttgaagctggaagagcctgcatgggcccttcttgaactggtgcagcatgtgcagcatgacatcactcaagagttcttgtcagagtgataatgaatgtctggctattgtaaacgggaacaagaaaactatttccagctgtgtgacaaccaagacgacaaaaagcattgcagagaatattattgccacaaggaccctgcttcatctgggtctcagacgacgggaggaggggcattttggagcacgtgtttggcatctgtgaaccttttgttaggtagaaaacaaggcctgaatgaaaggcctttcaaccacttctggagcagagaagataggtagagttactcattataggcaggtttcattgtaggagtattcagtgaggacccccgccttggaagtctgtaatcagcatatgataaggatggtgtgttcttactaagagaataacacaactgaaacagaattgccttttgttaaggggatgctttgccttcttggactacgattgtggggagaaggattattgtcaactaagtgaggcattcattctgtacccactatttattgtagttccacagagaactgcttgctttactttctgactaggcacagaaaagtaaaggttcaaaggctagggcaagatgactgacttttccagatttagcacaatctgttctctggtcactttgagacgctgtcantttagtttcatgcagctgatatcttggagaacttctgtgtccttacgtttggctgaggacactaaatttttttttttttttttttttttttgaggcagagcctcactttattgcccaggctggagtgcaatggcacgatcttggctcactgcctcctgggttcaagcaattctcttgcctcagccttccaagtagctgggaccacaggcgtgcaccaccatgcctggctaattttttttgtattttttggtagagatggggtttcactgtgttggccaggctggtcttgaactcctggcctcaagtgaaccacccgcctcggcctctcaaagtgctgggtttacaggcccaagccaccgtgcctggcctgaggacactaaaattaaaaaaaaattaagaaagtacggtccccgctcttgagtagctcatgaacatggagcganatggactcaaatgattaagatcaggtaggtagtgatgaatacggtaaaccaaggttcaaacaaagagctgtctgcatatctgaggatggagagggtaagtcagccttagaggagggaaatgacttgcagcaggatgccagcctcaatggtctgtggagctcattccatgcagaagagtaatgaggaagacccagtgagtgacaggcttggggaggagtgcctgaaattgacggtttgtggcaggaagtggtgggaccaatctcgaagcttgtggaggtagaagggtactggagactactgtggacaaaaaagggcatgttgatgccattaccagacaggacacgagagcatgatgattgttgcagtgaggcttgttagttttagacatgtctaaaaccatgcaggcagagattttcagctggtggctggcaatttgagtttgaagtttagctgagaagtcagttggcagtattcaggcataattgctaaatgtagaagtaantgccagtaaaatgtgtgtgataagctggagagcacttttagagtgaaaagattgatatattttaacaaggacaaggcttatttcaattctttaggttatttttctttagcagattaaagtagttttatcggttatcaagcatttgttgagcgtttactatggcttctcttgataggtggtcctggggagataggaaggaaatggtgcaaatttcaacaatacccactggggtgaacaaaaaatccctgaaacaccccattccagctattgttatctggaaaaaaatccttacaataattagatggtgatttgacgtctgggggaagttgcagatatagttttaatttactgtaggactagtggcagtgagtctcatattgctgtcatataaaaggtaaaccttccagaagaactttggaaatttcagtagcctaaagaccacgctttgagaaactcgtaaaggtttgtcatagaggttttaaaagtctgatcaaataattttaagctttagttgcctactaaaaagtaggatgcagtacaagtttgtcctttacttggt

SEQ ID NO: 312183 - DNA, 2301 bp, Homo sapiens
  misc_feature (851)..(851): n is a, c, g, or t
  misc_feature (1294)..(1294): n is a, c, g, or t
  misc_feature (1742)..(1742): n is a, c, g, or t
aatatttatgtatatttatgtgtgtgtgggataagtgtggatatgtttatacatactcatatgtatgtttgtgtgtgtatctgtctgtgcctgcctccattttcttttgctttagagaggctatacttgaggctgccatcaagagtgagaagtttgaagctggaagagcctgcatgggcccttcttgaactggtgcagcatgtgcagcatgacatcactcaagagttcttgtcagagtgataatgaatgtctggctattgtaaacgggaacaagaaaactatttccagctgtgtgacaaccaagacgacaaaaagcattgcagagaatattattgccacaaggaccctgcttcatctgggtctcagacgacgggaggaggggcattttggagcacgtgtttggcatctgtgaaccttttgttaggtagaaaacaaggcctgaatgaaaggcctttcaaccacttctggagcagagaagataggtagagttactcattataggcaggtttcattgtaggagtattcagtgaggacccccgccttggaagtctgtaatcagcatatgataaggatggtgtgttcttactaagagaataacacaactgaaacagaattgccttttgttaaggggatgctttgccttcttggactacgattgtggggagaaggattattgtcaactaagtgaggcattcattctgtacccactatttattgtagttccacagagaactgcttgctttactttctgactaggcacagaaaagtaaaggttcaaaggctagggcaagatgactgacttttccagatttagcacaatctgttctctggtcactttgagacgctgtcantttagtttcatgcagctgatatcttggagaacttctgtgtccttacgtttggctgaggacactaaatttttttttttttttttttttttttgaggcagagcctcactttattgcccaggctggagtgcaatggcacgatcttggctcactgcctcctgggttcaagcaattctcttgcctcagccttccaagtagctgggaccacaggcgtgcaccaccatgcctggctaattttttttgtattttttggtagagatggggtttcactgtgttggccaggctggtcttgaactcctggcctcaagtgaaccacccgcctcggcctctcaaagtgctgggtttacaggcccaagccaccgtgcctggcctgaggacactaaaattaaaaaaaaattaagaaagtacggtccccgctcttgagtagctcatgaacatggagcganatggactcaaatgattaagatcaggtaggtagtgatgaatacggtaaaccaaggttcaaacaaagagctgtctgcatatctgaggatggagagggtaagtcagccttagaggagggaaatgacttgcagcaggatgccagcctcaatggtctgtggagctcattccatgcagaagagtaatgaggaagacccagtgagtgacaggcttggggaggagtgcctgaaattgacggtttgtggcaggaagtggtgggaccaatctcgaagcttgtggaggtagaagggtactggagactactgtggacaagcagtgaggcttgttagttttagacatgtctaaaaccatgcaggcagagattttcagctggtggctggcaatttgagtttgaagtttagctgagaagtcagttggcagtattcaggcataattgctaaatgtagaagtaantgccagtaaaatgtgtgtgataagctggagagcacttttagagtgaaaagattgatatattttaacaaggacaaggcttatttcaattctttaggttatttttctttagcagattaaagtagttttatcggttatcaagcatttgttgagcgtttactatggcttctcttgataggtggtcctggggagataggaaggaaatggtgcaaatttcaacaatacccactggggtgaacaaaaaatccctgaaacaccccattccagctattgttatctggaaaaaaatccttacaataattagatggtgatttgacgtctgggggaagttgcagatatagttttaatttactgtaggactagtggcagtgagtctcatattgctgtcatataaaaggtaaaccttccagaagaactttggaaatttcagtagcctaaagaccacgctttgagaaactcgtaaaggtttgtcatagaggttttaaaagtctgatcaaataattttaagctttagttgcctactaaaaagtaggatgcagtacaagtttgtcctttacttggt

SEQ ID NO: 312184 - DNA, 968 bp, Homo sapiens
  misc_feature (794)..(795): n is a, c, g, or t
  misc_feature (798)..(798): n is a, c, g, or t
  misc_feature (811)..(811): n is a, c, g, or t
taaggcacctgctggttgcaggacctcgctttccatctgttcttgttgcaatgccatcttcaagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaagagctgtactatnntanaccaaggtgagangtaagacggaaggcagattacgcttgtgggccttgatggctccgtcggccgagtgcttagccattgtggaggaagacaccccgcggtggcccaaaagcgggcgttacgttcggcccgcaggggggcgagaacacaagatgcgagtgggtctatacaa

SEQ ID NO: 312185 - DNA, 2874 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312186 - DNA, 2894 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtcaaaaaaaaaaaacccgaattc

SEQ ID NO: 312187 - DNA, 2889 bp, Homo sapiens
taaggcacctgctggttgcaggacctcgctttccatctgttcttgttgcaatgccatcttcaagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312188 - DNA, 2904 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtcaaaaaaaaacacaaaaagaagaagcagcgaa

SEQ ID NO: 312189 - DNA, 2820 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggttgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312190 - DNA, 2606 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccactgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312191 - DNA, 2801 bp, Homo sapiens
aataggctaaggtaagcggttggttggaaatctcctgccatggagtctacgatgtgatcgcaacagcctttcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312192 - DNA, 2807 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312193 - DNA, 3082 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccactgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtcaaaaacaaaaacaaaaaaccccgagtttttttttttttttaataattattgtttttttttttttttattaaaaagcccaccaacacagggggggggcacccaaaaaaagcaaccttaaaaaaggcgctcctagggcggggggcccaacacacaacagagaggacacgcgcagtagacgcagacacaacactaagcggagggggacgcagacaaaaacacacaaggaacgggcggccgcaaccaaagcgcaagagacagccggagaaagccgagcaaccacaacaacgagcgccacgaaaaacaccggaacaacaaagaaagaggagagcacagacagaagcagagcggaagaaggaggaaacaacaaaccagaagagaaaaagacgccgataaaagaagaagaagaaacagcacgtcgcgttcgccaatgagaaaagcaaagcaacagaaagacgacgaccagcaagaaaaggacag

SEQ ID NO: 312194 - DNA, 2377 bp, Homo sapiens
cgctaggtgaggcgggtgttatcggccgaggctcatgcagctgtttcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312195 - DNA, 2564 bp, Homo sapiens
tcctggtttttttatttttatttttttaacatccttgaagaagtcataatacatttaaaacatttgtctttgtaagtaaactgaaacctcctgccacctgtggctatagggaaaactcgagctgggtaggaccagaaccatatgagtggtagaaggagaaagatgcctgggcctgggctgaacttaggttgtggtctcagacctaggatccaggggccaagtttccaagcttgcccatcaggaaggtggagcggttaagaactcatatgctaaatgccacccagtgaaggccaacagagacctcactgcccctgcttctgggcagcagctatagtgaccattggggccatcacaacgtttagacaggtttgtgcagcagcacattcctcccctgggcctttgactggatgtgcaccagatttcctgccagcctgactgtcttgcttggatctgcagagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312196 - DNA, 1715 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312197 - DNA, 1445 bp, Homo sapiens
  misc_feature (1370)..(1370): n is a, c, g, or t
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcactgcggnctgaccacaggcttcgtgccatgtatgtgggtgaagtgtccccacacccttcggggggcctgggcacccggaccg

SEQ ID NO: 312198 - DNA, 1206 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgaggtaggtggcctgccttctttcttcggtccccttaggtccacaaaagctctgggcccaaccagaattctccatcagggtctggagtctggcaggccagtccctttacaccaagcttgtccaacccctggcccatgggctgcacgtggcccaggatggctttcagtaaggcccaacacaaagtcgtaaactttcttaaaacattatgagattcttttgcaatttttttttttagctcagcagctgtcattagtgttagtgtatattatgtgtggcccaagacaattcttcttccaatgtggcccagggaagccaaaagactggacaccccagccttacaccctctctct

SEQ ID NO: 312199 - DNA, 852 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaagtaagtgctgccccctgggcctagggatggagtgggggttgggagcatagcacccaggaccttggtgacctgccagtgaagccagg

SEQ ID NO: 312200 - DNA, 647 bp, Homo sapiens
taaggcacctgctggttgcaggacctcgctttccatctgttcttgttgcaatgccatcttcaagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggatgctcctctgagaaagtctgcagctggtccttagaatagacatattgccaaatgcgtt

SEQ ID NO: 312201 - DNA, 465 bp, Homo sapiens
aagcaccaggctgtggcctcccacatctcccgcctgccatgtcctgctgaggcctcccattggccagggatgctgtgggtgggcctgttcaggttcttgacatctgtgcacgaaataatttgggagcaagtccaaagtaagagtgggcaaagaagtttatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312202 - DNA, 2380 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312203 - DNA, 2798 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312204 - DNA, 2824 bp, Homo sapiens
taaggcacctgctggttgcaggacctcgctttccatctgttcttgttgcaatgccatcttcaagtggcgctagcggcggacccggctgggcagttccttccccagaaggagagattcctctgccatggagtcctacgatgtgatcgccaaccagcctgtcgtgatcgacaactgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312205 - DNA, 2637 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312206 - DNA, 1736 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatgtacgagaatctcgtacatggtcttctcgtaaacggttttctcgtacatggtctctctccatgttggtcaggctggtctcaaactcctgacctcaagtgatccgcccgcctcgccttccaaagtggtgcagta

SEQ ID NO: 312207 - DNA, 2060 bp, Homo sapiens
ggctctaagtacttaccctgcccctgaatgggcagcaccattgagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggttttggtgacaggctcctgagtgaagtgaagaaactagctccaaaagatgtgaagatcaggatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312208 - DNA, 2511 bp, Homo sapiens
taaggcacctgctggttgcaggacctcgctttccatctgttcttgttgcaatgccatcttcaagtggcgctagcggcggacccggctgggcagttccttccccagaaggagagattcctctgccatggagtcctacgatgtgatcgccaaccagcctgtcgtgatcgacaacgagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactacctgcctgatggcagcaccattgagatatctgcacctcaggagagactgtattccacgtggattgggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgcgcacatgcgagtgccgtgtggccctgggaccctgggcccagaaaggacgatgaactacccgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctccctctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaatttttctttggcagaggcccctaagcaagggaggggtgttggagagccagtgcccttaagactggagaaagctgcaatttaccaagttgccttttgccactgtagctgaccaggggactaggttgtagaggtgggaaggccccctctgggctgatcttgtgccattcttgaccttggacctgcttggttaaggagggagtgggccagaccagagtgccaggagctaatggagccaggcctgactcctaggagtggtccaaaggccttcagcctagatggtgcaaagctggggccagcctgtcttcaccggcaccctcacctgtgacaccaagacccaccccaatcccagacttcacacagtattctcccccacgccgtcctatgaccaaaggcccctgccaggtgtgggccacagcagcaggtatgtgtgaaagcaacgtagcgccccgcggactgcagtgcgcttaaccaactcacctcccttctcttagcccaagcctgtccctcgcacagcctcgcacaaaccacattgcctggtggggcccagtgtactgaaataaagtcgttccgatagacacgtca

SEQ ID NO: 312209 - DNA, 944 bp, Homo sapiens
  misc_feature (841)..(841): n is a, c, g, or t
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgcatcgacatcgcgggccgggacgtctctcgcttcctgcgcctctacctgcgtaaggagggctacgacttccactcatcctctgagtttgagattgtcaaggccataaaagaaagagcctgttacctatccataaacccccaaaaggatgagacgctagagacagagaaagctcagtactactgctgngggggcccattgggatgggccttccgttcgggccctggttgtttcggccattgatgggggaggggggtcccagccgggtgccccaatcggcgggggccgctct

SEQ ID NO: 312210 - DNA, 860 bp, Homo sapiens
cgctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggcaggagcccttgaaggcgacatcttcattggccccaaagctgaggagcaccgagggctgctttcaatccgctatcccatggagcatggcatcgtcaaggattggaacgacatggaacgcatttggcaatatgtctattctaaggaccagctgcagactttctcagaggagcatcctgtgctcctgactgaggcgcctttaaacccacgaaaaaaccgggaacgagctgccgaagttttcttcgagaccttcaatgtgcccgctcttttcatctccatgcaagctgtactcagcctttacgctacaggcaggaccacaggggtggtgctggattctggggatggagtcacccatgctgtgcccatctatgagggctttgccatgccccactccatcatgcgccttacatcttcgcccggacctttctactttctgaactctacctggtatgaaggcttcacttccactatcccttattttaaatgtactgccttaaataaaccttgtccttcctaacctccaaagatttacctttatccagttaatcttccttcttatgtatccctttgaatggtccttctatatcgtccttaattgttctaccctg

SEQ ID NO: 312211 - DNA, 265 bp, Homo sapiens
ctggcaaggagagctaattagctttacagggagaagaaaacctgaatttccacaatgtcaataaatattagaaattaatggaatgtcaaattgctttctataatagaaaaaataatgagaaaactacactaccttttgttgttgtttctcattaactaaccatcacttcctgcctcatcatgatagggcctcaccacagcctgcatccagccagcaaatgagaaaaaggagaatagaagtagttgatttccttcttaaaatccat

SEQ ID NO: 312212 - DNA, 1069 bp, Homo sapiens
taattcttcagctaaaacagcggaagaggtgatttattatatggttgttacactcggccacaaataaacacagaaatagtccagaatgtcacaggtccagggcagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaa

SEQ ID NO: 312213 - DNA, 2527 bp, Homo sapiens
tggggggatgctgtgtgggtttcaagaagacgccacgcctccgccgccgccacgcccccgccgcctccaccgccggctgccgcgcccggaggaggtcgggatgttatcacttccgccggggcttctcactgcgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaa

SEQ ID NO: 312214 - DNA, 2563 bp, Homo sapiens
tggggggatgctgtgtgggtttcaagaagacgccacgcctccgccgccgccacgcccccgccgcctccaccgccggctgccgcgcccggaggaggtcgggatgttatcacttccgccggggcttctcactgcgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaa

SEQ ID NO: 312215 - DNA, 3758 bp, Homo sapiens
tggggggatgctgtgtgggtttcaagaagacgccacgcctccgccgccgccacgcccccgccgcctccaccgccggctgccgcgcccggaggaggtcgggatgttatcacttccgccggggcttctcactgcgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaagtttaattaccgacaaaattatttctaaaacaacagattgatctgatattgtgtcatatacttgaaaggctcatacacagctggtaagcataataccttccaaatttgaaggtcatggctactcttcaacccttcctgtaaggtattttacaaaacagtggcctagagtagcaaaattgaagtggatgtgagctaacctttcaagatttagtctatcctagattgaacacacatgtggctgtgaccattctcatgtacttacaaaccttctgttacaaaagggaactttcctatattttttgtcctcctcagtcctaaacttggcatgctaacttaaaaccagttataggagagagatgctggaggattcccaggatgaaacattcctcagcagcctcctgacttaactcagatccagcagctcttggcagatcctgaactaatgtcattacagtgaattgagccaaaacgattattgcttgctcacattttaggaacactttttgttgaagaagcaaactaacaataacaagttaggcattccttctgaatttaccatataaggattatgtataaacaattatattgaatttgtcattagattctatatttgtagacgatttaacgtagtctttcatctgtacatctttatcttgttcaaaatgggctgaggtttttaataggtggttttctaccacattaagtacttggttcttcattttaaaaaatatgaagaataacttcaactcttttttgcattattttgatttttgattttgcagtcattgctcctaactgtagatacatgttgcaaaagtgatgtttttctgaattttttttaaaagtagaagactattctgttaaacattaaaattcagagacaacagtgataacacctgggatataatgaaaatgaggtgctgtgaatcagtaaactaaagggatacctgctttaacctgcaccttaatggaatctggtatagagatgtacccacaataaatgttttataagatttaagatcataatagtaggttagaggaagagcatttattaagtctgttgtttctaatctatagctaagttaacatctcccatattattccattttaatttcccattactgaccaaggtgaaagtatatgtgactgtacttttatctttctgttgggatcatggatctaatttaactggcttaatttgatgcttctgtcactaggctctaagtgccc

SEQ ID NO: 312216 - DNA, 2407 bp, Homo sapiens
gtttgtatttggcagtttggccccccaccccgtcgcttttccgtttctggtagttgtgctcgggatggaaccttgcccctcctccgctcccccacccttttaccctggtgtgggtgaagtggctgggctacgatggttcagtatttatgaccagcgtccgtcctggtacagaacaaagaaacttggacttctggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaa

SEQ ID NO: 312217 - DNA, 3272 bp, Homo sapiens
tggggggatgctgtgtgggtttcaagaagacgccacgcctccgccgccgccacgcccccgccgcctccaccgccggctgccgcgcccggaggaggtcgggatgttatcacttccgccggggcttctcactgcgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttggtaaggactataatactgaaattttgaaaattattactacattgaaaatcagctaaactgcaatctcaaaacataaattacacttaatcattggtgcttatgctttggctaatgctaatttaaatagacttctgcatgtatacttcaaagtattataaatacatttctgctttataaactgatcaaatgagaagtgatcattgagtagttaaccacttcctatctggtattacagttaatttatgtgctcaacaacaacaaaattggctcccagatagctacttgaagtaacctatagtcataactgccagggagaatattgtcacaagttgaatctggaaaggcattgtaaggccagtgtactaagattttgatgactctacaaattatattttctgaacttgtggatacacgtttcactatgattaggtggtttttgctaaattgggcaataaaagttaaagaaccatgatttccaaagacataaaacagcctcatgttaagaataagccttttcctcctttatggaagagagattgaaaattgtgcagatggtataatgaaaattctctgtaaaatctaggtagtaaagtggttaacgtataatttgatttttgttgtgtaacaatttgtgattcaaaaactttgtattttgacaatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaa

SEQ ID NO: 312218 - DNA, 2373 bp, Homo sapiens
gtttgtatttggcagtttggccccccaccccgtcgcttttccgtttctggtagttgtgctcgggatggaaccttgcccctcctccgctcccccacccttttaccctggtgtgggtgaagtggctgggctacgatggttcagtatttatgaccagcgtccgtcctggtacagaacaaagaaacttggacttctggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaa

SEQ ID NO: 312219 - DNA, 1469 bp, Homo sapiens
acatttcttgccagtgtcctcctgcctttaaaaattctcttttctggttggggaaatgatgtttggtaactgtttttactatgtctgcttctttgcaaagctttgtctttaacagagtaatattctatgctaaaatagtcattatttttagaaagaaaattgttcagttgctggtttcttattttatatattcttcattaaacagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaa

SEQ ID NO: 312220 - DNA, 1830 bp, Homo sapiens
attatttccggttgtgattcatgttatacttttatagactacttataatctaagagatgatttctctaattgatcagtactaaagagcattctccaaacttgaacatagtgctcaacaaatttgagtaaactgatcatcaatattattattgaataatcatattgctaaataaataaaaatatttaaatcatcataaccttaatgttttccagtgactgaaattctgttctgattatcagattcacattcttccatgtaacttcttggacttggtagaaggctgttaacataaataactgagtattacaatgcatgtggaaaagtttctttgttctgctcacctgaggttttagtctatttaatgtatgaaagtcagatttattaagtaaatttttactttctacatcatgtagtaaatatttttggttttgctggaaaatttaaatgagtttatttttagtagcttttttcaagtttttattcattttcataacatgtatatttactgaaataactcttccctacaaaggtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaa

SEQ ID NO: 312221 - DNA, 1746 bp, Homo sapiens
attatttccggttgtgattcatgttatacttttatagactacttataatctaagagatgatttctctaattgatcagtactaaagagcattctccaaacttgaacatagtgctcaacaaatttgagtaaactgatcatcaatattattattgaataatcatattgctaaataaataaaaatatttaaatcatcataaccttaatgttttccagtgactgaaattctgttctgattatcagattcacattcttccatgtaacttcttggacttggtagaaggctgttaacataaataactgagtattacaatgcatgtggaaaagtttctttgttctgctcacctgaggttttagtctatttaatgtatgaaagtcagatttattaagtaaatttttactttctacatcatgtagtaaatatttttggttttgctggaaaatttaaatgagtttatttttagtagcttttttcaagtttttattcattttcataacatgtatatttactgaaataactcttccctacaaaggtatgaagaagaaaagtttaaaaagaaacaaaaaagagttgatcaagaacttaatggaaaacaagatgaaccgaaaaatgaacagtaagtttggcatctagtccaaacaagactgaagaatgtgctgatggagcagtgctgtttctgcattaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaa

SEQ ID NO: 312222 - DNA, 1064 bp, Homo sapiens
aagcagtggtatcaacgcagagggcccattacggccgggaagcagtggtatcaacgcagagtgcccattacggccgggtatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaa

SEQ ID NO: 312223 - DNA, 354 bp, Homo sapiens
tgtgtgtgtgtgttttttttttaaactccaggttacggaaaaatctaaaatccctaatcattgtacatccttcttggtttatcagaacacttctggctgttacaagaccatttattaggtaatttttgagagccattgactttaattttattttttttatttatttatttttagttaacacataataactatacatacttatgggatacagagctatattttgatatgtgtatacattgtataatgatcaaacctgggtgattagtacatccatcacctcagacatttatcatctttttgtgttttgaacattcaaaatgacatgatttttgtatcttgtaaacattgtatcca

SEQ ID NO: 312224 - DNA, 644 bp, Homo sapiens
agaggaaacccagagagttacccttggtagggggagccatagaacctgctcgggaggtgcttcctggatccccgccctgcttaggtccccgcccttggcttgggtcctgtttgtatttggcagtttggccccccaccccgtcgcttttccgtttctggtagttgtgctcgggatggaaccttgcccctcctccgctcccccacccttttaccctggtgtgggtgaagtggctgggctacgatggttcagtatttatgaccagcgtccgtcctggtacagaacaaagaaacttggacttctggtatgcctcgtaaccgcggggaatagacacggaagcagcataagtaatcagggctttaatagatcttccctagtacgctaaaccaaatacagagtgtgtacgtcaaaagccgagtccccgcgtgaatctagacacaaccctttctgtttaaatacctggcaaaatggtttggatttctggatgcatttcatgccgctggagagttacttgtctgtgtcttgtgagctctttgacgaaacagcttttccggtgttgcatcaagatagttacggtgcctcctatttatttaattgaataaactatgtgattgcattttagtgttgcttttttcattctcaccttc

SEQ ID NO: 312225 - DNA, 2301 bp, Homo sapiens
tggggggatgctgtgtgggtttcaagaagacgccacgcctccgccgccgccacgcccccgccgcctccaccgccggctgccgcgcccggaggaggtcgggatgttatcacttccgccggggcttctcactgcgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgtttaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaa

SEQ ID NO: 312226 - DNA, 3363 bp, Homo sapiens
  misc_feature (2950)..(2950): n is a, c, g, or t
tggggggatgctgtgtgggtttcaagaagacgccacgcctccgccgccgccacgcccccgccgcctccaccgccggctgccgcgcccggaggaggtcgggatgttatcacttccgccggggcttctcactgcgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaaaaaaaaaaaaaaaaaaaaaaaaaaaaaaaaaaccgcggggcgctttttttgtggggggcggcgaaaaagagggcgttattgtgaggtgggcgcccgtgtggtccttcgcgtgtgtttcccttggccccatttttttgtgtccagcggtgggtaataacttcgtgcgcgggctccccctattttgtgggaggcgctcgatattaattttgccgatttagcgccccggtgttctcccccctgcttattattagtatcttcccgtcttacctccccccggggcattactacttctccccccgtccctgctagcacggcgcgcattatctctgtgtgtatccccaacgagaacttcttttcagcaataaccccttttcattctctctggcggacgatcaaatcctctgcgttgcgtcgtcggcccanagcacaacacagccccgccggcttttaccggcgcggtgtggtgtttttggtattgccgggacacacactcacgtctgcccaccacctattttatctcgcgaggaggtactctgttgtttcttcgaactcgactcgcgatgtttatccatactctccgtggtctctctcttgttgttaccccgggtatttacgtcgccccaccattttagacacactttctttgtagccccgcgttatatattactatcgagctctggattatctagtggtcccaccagtggtgacttccgcccagtcgcataactcgtttcttcaccggcgtcgccactaacacgatgcctagtgcggaacagcgccagcgctggacaacggggcttctaccttcccccttttcatctactattacgcgtgta

SEQ ID NO: 312227 - DNA, 2614 bp, Homo sapiens
tggggggatgctgtgtgggtttcaagaagacgccacgcctccgccgccgccacgcccccgccgcctccaccgccggctgccgcgcccggaggaggtcgggatgttatcacttccgccggggcttctcactgcgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagtcatttcctggaaggatattttccgttaacagctttgtcttggaaacaactaacatgcagtaggtttccccctccccccatcttttgatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacaagttgatcaagaacttaatggaaaacaagatgaaccgaaaaatgaacagtaagtttggcatctagtccaaacaagactgaagaatgtgctgatggagcagtgctgtttctgcattcataatgcatttattggcccatatttttatgtaacctgttacaaaatagacttgactttttcataatggacttttgtattatacaagggactgttcactgctgtactggtttgcaaatttcttgaatttagctctttaatagctaactgtattattatcgttttatattttatattgctaaatagagaaccacactttatataaagtagtttttgcatttgtttattgaatgatgcatcttcttcggtgaaatatttatatgcataaatggcaaaggaaagaaataatatatatttttatgtcattgagcaatattttttaatgtgtacctgtcttatggaagaaatatgcaggtatataagaccacgattttctaaagtgcatattagaatttttgtttttgtaaatggttaaatacatttcctgggtaacttaggaaattaagtttttcataaggcaacagatggttaaactgattgtcatgaatacccaaagatcatgtatataatcgaagtgtattagtaccatcccaaggtgtttttctcatttaacatatttgtttcataattcagcaagtacagatgcaagcgcattgcacactttttcctttctaaacttaaagacaagtcaaaaagccattcttagaactagaggatttaagagggtaggaattagggtttgtatatatgtatatatgggacattttatcttctggcccaaagtcagaactttataaaaatcttgagtttgttcactaatgtgaaataagctatgtgtccagggtattgctcccctgagtgtatatgagtgctgagtagtattgcagagaatgtgatgagttattcactgtcacaactttttctatagaaaacaggggctgctttttaaactctcactatgggcactttaccaaaatacttccatatcaattatttgaactcggtagttgtttgacctagttagatgtggtgtttattcaagtttgtatgaaatcatgtttgacaatactgtaaattaggttaattttgtaagtcttagcatcatcatattgtgctgttttggataacacgtttgttacaagcatttaaactgtttcatttggtagtacctttacattgaaataaattgtgtttgtgcctccaaacaaaa

SEQ ID NO: 312228 - DNA, 1400 bp, Homo sapiens
tggggggatgctgtgtgggtttcaagaagacgccacgcctccgccgccgccacgcccccgccgcctccaccgccggctgccgcgcccggaggaggtcgggatgttatcacttccgccggggcttctcactgcgtccgggtcagctgctgccgccgacgccgtaccgctgcggccgggggattgggccggggtctccaccgccgaccgaggggagcgggctccgctcggccctgctttttgcgacctggccgtcagccccacgtcgccggcctggaggggcgaagaggacgagggggccaaggcttcctccggggacattggctccctggattatcaagagtttgtagttgacattgaatccaggctgaggatggaaggtgtggaacttaaagaagaatggcaagatgaagattttccgatacctttaccagaagatgatagtattgaagcagatatactagctataactggaccagaggaccagcctggctcactagaagttaatggaaataaagtgagaaagaaactaatggctccagacattagcctgacactggatcctagtgatggctctgtattgtcagatgatttggatgaaagtggggagattgacttagatggcttagacacaccgtcagagaatagtaatgagtttgagtgggaagatgatcttccaaaacccaagactactgaagtaattaggaaaggctcaattactgaatacacagcagcagaggaaaaagaagatggacgacgctggcgtatgttcaggattggagaacaggaccacagggttgatatgaaggcaattgaaccctataaaaaagttatcagccatgggggatattatggggatggattaaatgccattgttgtgtttgctgtctgtttcatgcctgaaagtagtcagcctaactatagatacctgatggacaatctttttaaatatgttattggcactttggagctattagtagcagaaaactacatgatagtttatttaaatggtgcaacaactcgaagaaaaatgcccagtctgggatggctcaggaaatgttatcagcaaattgatagaaggttacggaaaaatctaaaatccctaatcattgtacatccttcttggtttatcagaacacttctggctgttacaagaccatttattagctcgaaattcagccaaaaaattagatacgtgtttaatttggcagaactagcagaacttgtccccatggaatacgttggcataccagaatgcataaaacagtatgttttgttttatttccttaattgtattggatcttaacattttgatgtgcaatggataatacttttcaatactcattctttatgtattatattttataactgtgcgcgcgcgcgcgtgtgtgtgtgtgtgtaac

SEQ ID NO: 312229 - DNA, 1136 bp, Homo sapiens
agaaaggctttaggcaggccaagggagaaacctggctgatacgtggccccagacttggcttggcatgatgagccgtgtgacatcagacaagcccctcctcctgcctggctccatctcccaaaatgggatgggggaggagtgacggaggcagaatgcaaggttggctgtacgtggctgtgcgtggggcactggctgggaactttgcaagctctcttgtctgactctgcagtaacctgggagagggtctgatcccactttataggggacagagagggtcaaagaggctgaaaatctgcctggggccaagagggagaagcagagcagtcagcccaggtcctcctctggtgcccggtgcccctgaccttgctgagcactgagagcaaactgagttaacacgtagggaagcagaacgtgctgagtaacacacaacacataccagttccctgcctgttactcattttgccctcagccttgcacttccctcaggctcaagacaagggatgtggcatgtatgaggtgacaaagtcgtcaccaagtgagctactgccagctgtctgctttgtccaaagtactgtctctctctcatttagttttgctttcatctaactcagggctccatctggaagcagttgctcccaggcatgagcccagagatgtgtgaccaccccttgggtgcacagcaatgacaggtcctgcctcctccagccctcagctattaaggagggagtgatatattccacttaactgatggggaagctgaggctcagagatgtggcccacttgtgcccacaggcctgatttcctgcctcacacccaggctctagggcagtaggcttgttgctgacagcctgggcctaaccccatctgctcacctcatgttgcctgatctgctgatgcagggtggtaagttgagtgcagcccaacaggtggatggggactcctaaatatcccccaaatgctggactcactgccacccccacaaggacacatgggcatcctgtactgagactgcaagcacagcatatgggggacctctaagggccctaaggctgtgctgtccactatgaatgcactatgtaaattaaattcaaatgaacaaaaattaaaatttaaaatttgtccttcaatcacactgg

SEQ ID NO: 312230 - DNA, 2065 bp, Homo sapiens
agaaaggctttaggcaggccaagggagaaacctggctgatacgtggccccagacttggcttggcatgatgagccgtgtgacatcagacaagcccctcctcctgcctggctccatctcccaaaatgggatgggggaggagtgacggaggcagaatgcaaggttggctgtacgtggctgtgcgtggggcactggctgggaactttgcaagctctcttgtctgactctgcagtaacctgggagagggtctgatcccactttataggggacagagagggtcaaagaggctgaaaatctgcctggggccaagagggagaagcagagcagtcagcccaggtcctcctctggtgcccggtgcccctgaccttgctgagcactgagagcaaactgagttaacacgtagggaagcagaacgtgctgagtaacacacaacacataccagttccctgcctgttactcattttgccctcagccttgcacttccctcaggctcaagacaagggatgtggcatgtatgaggtgacaaagtcgtcaccaagtgagctactgccagctgtctgctttgtccaaagtactgtctctctctcatttagttttgctttcatctaactcagggctccatctggaagcagttgctcccaggcatgagcccagagatgtgtgaccaccccttgggtgcacagcaatgacaggtcctgcctcctccagccctcagctattaaggagggagtgatatattccacttaactgatggggaagctgaggctcagagatgtggcccacttgtgcccacaggcctgatttcctgcctcacacccaggctctagggcagtaggcttgttgctgacagcctgggcctaaccccatctgctcacctcatgttgcctgatctgctgatgcagggtggtaagttgagtgcagcccaacaggtggatggggactcctaaatatcccccaaatgctggactcactgccacccccacaaggacacatgggcatcctgtactgagactgcaagcacagcatatggggtctgtctccaagccctgtttccttctcaggcctactgcctccccagtgcctctgcctgtgtggtccacccttgggttcagcgctatgcctatgcagttggctccctccaatcctcaagctgagtgggtaaattacgctttgcagagtgagggttgccaccttcctaagcctggaacagactggacttgtatgcttgtaaatcacctggtcctcctttccctaggcgtgagtcgcctctgaagctttgccagtggggcattctggctccatctctgctcctccattttcttatccataaaatgtagataataatagtgctcccaaagggacaaaatgtagacctactctatgtgaggctctggcaccgttgcatacctccaggagtggggtgctcaccagcatccaggcagccccatctattgtggggtggcatcataggagcaacttgttttaggggaggagggagaaagccaaggaagggttaacccaggatctcaacaaatgtctggcaatgggattttcccacaatacggccaactgaaggccccttgagaactaagagttttcccatcctggagcttctcagccatctggccttaggaaaccacagtctttcctgcctcctggcttttgcaagctcttccatcactcccgcctgcacacaccttctattggaagtcctctcagattattcaggtcaaaaccaactctacatttatgggttcacccagttctggtcctcttgtgttacctcagcagcagcagcatgtgtgattttcctaaatccttgaggcactgaaggatgaagaaaaggacagtgggtgtggcactggggaagtggcttccagtcattagccacccagagctaacctcctctcttccctgaacttcagtttccccatcttccaaatgtgaaaatcgggcttggggacctctaagggccctaaggctgtgctgtccactatgaatgcactatgtaaattaaattcaaatgaacaaaaattaaaatttaaaatttgtccttcaatcacactgg

SEQ ID NO: 312231 - DNA, 1344 bp, Homo sapiens
  misc_feature (1)..(1): n is a, c, g, or t
  misc_feature (12)..(12): n is a, c, g, or t
  misc_feature (26)..(26): n is a, c, g, or t
  misc_feature (55)..(55): n is a, c, g, or t
ncctcccccctncccttttcgtcttnccgttaaggtggaggaggtcaccgatgtnaccattgtgcccacaggcctgatttcctgcctcacacccaggctctagggcagtaggcttgttgctgacagcctgggcctaaccccatctgctcacctcatgttgcctgatctgctgatgcagggtggtaagttgagtgcagcccaacaggtggatggggactcctaaatatcccccaaatgctggactcactgccacccccacaaggacacatgggcatcctgtactgagactgcaagcacagcatatggggtctgtctccaagccctgtttccttctcaggcctactgcctccccagtgcctctgcctgtgtggtccacccttgggttcagcgctatgcctatgcagttggctccctccaatcctcaagctgagtgggtaaattacgctttgcagagtgagggttgccaccttcctaagcctggaacagactggacttgtatgcttgtaaatcacctggtcctcctttccctaggcgtgagtcgcctctgaagctttgccagtggggcattctggctccatctctgctcctccattttcttatccataaaatgtagataataatagtgctcccaaagggacaaaatgtagacctactctatgtgaggctctggcaccgttgcatacctccaggagtggggtgctcaccagcatccaggcagccccatctattgtggggtggcatcataggagcaacttgttttaggggaggagggagaaagccaaggaagggttaacccaggatctcaacaaatgtctggcaatgggattttcccacaatacggccaactgaaggccccttgagaactaagagttttcccatcctggagcttctcagccatctggccttaggaaaccacagtctttcctgcctcctggcttttgcaagctcttccatcactcccgcctgcacacaccttctattggaagtcctctcagattattcaggtcaaaaccaactctacatttatgggttcacccagttctggtcctcttgtgttacctcagcagcagcagcatgtgtgattttcctaaatccttgaggcactgaaggatgaagaaaaggacagtgggtgtggcactggggaagtggcttccagtcattagccacccagagctaacctcctctcttccctgaacttcagtttccccatcttccaaatgtgaaaatcgggcttggggacctctaagggccctaaggctgtgctgtccactatgaatgcactatgtaaattaaattcaaatgaacaaaaattaaaatttaaaatttgtccttcaatcacactgg

SEQ ID NO: 312232 - DNA, 694 bp, Homo sapiens
  misc_feature (576)..(576): n is a, c, g, or t
  misc_feature (581)..(581): n is a, c, g, or t
  misc_feature (606)..(606): n is a, c, g, or t
  misc_feature (610)..(610): n is a, c, g, or t
  misc_feature (613)..(613): n is a, c, g, or t
  misc_feature (630)..(630): n is a, c, g, or t
  misc_feature (632)..(632): n is a, c, g, or t
  misc_feature (644)..(644): n is a, c, g, or t
  misc_feature (649)..(649): n is a, c, g, or t
  misc_feature (651)..(651): n is a, c, g, or t
ccccgactagcccgacaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctaaaaaaaacaactgctttttttncctancattcagtgattactgtcaggctgntttncanacttggattttgacttngngctttagaaatncgggngnatgctgtgtccccgtgagcttaggggggttctggtggcgtacc

SEQ ID NO: 312233 - DNA, 637 bp, Homo sapiens
  misc_feature (636)..(636): n is a, c, g, or t
ccccgactagcccgacaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctaaaaaaaaactatctctctcccgacacttgcagccgctctacctctcgttccccgcgtcgtgtcttgccactctgtcccaaana

SEQ ID NO: 312234 - DNA, 1794 bp, Homo sapiens
gtaaatgttcaggggtgctgtcacctccctgacacctcctttacagcccccttttccccagcgcgtggtatgctctgacttagttgggctctaccaggacaccgtactgctgcaaagtgctcagtgggtgaggtgggagagggagaagctgtcgaatacccttcggtgagcccgaccccaacacctgatggttaagaaaaatgtctctgctttctgccttttggaaattttgctctttctctttttcacagtgagttatacaagagtcagctgaaaagggatcttccaaaaggctgtcactctaagagaatatttgtcctcttgggtatccctagtgtactagctgtggattccactcttagttactgaattatatttttgtctttgtcaaaaaacatttcacaagataataatccatattatataatcccttaagttccatacatactttgggagacgtaccgaccagatttcagttgttattaaatgaagcttgtaaagcttttgttgttttgttagggtgagtaatttctgcccgtgccccaccacagtgcaccaatcacagacgaaatgaaggaagcacttgctgcgtctgtcctaatacgcacatgagcagggggagaagtgctcattgcagaagcattgtgattagcatctgcatgtcatgagcccacgccaaaaaactgcatgcagattgtccttttcccaaatctaagcagacttctagctccctgtcagttaccagtgttcttgatactcttgtctttttacttcttgtcttgattatgaaataagccttttgatgctctttaggctgcttgtgtgccgtttgtccctcataagaatacttccttttaccccaattttcttttatctcattccctaagacaaagtccctcacccattaaaggcacgtgaagtactgagctcttgtaatatcaatatgtctgtgaataaatctagaaataaagtttctttgaccagagctgagctgggtgtggggaggttggggaagtgcccgtctcagttctgggtgggcggcagtgaccatgcacttctctaccaagggctggggagaaggctctgctcctacaggtcgcattctccaggggcaggagggtgggagggaagctagagacccagaatggggatatttgaaatctgcattgatgaggggcctcctttcccaaagaaagtggaagtatccccttacaggctgaatgggaccaaggagccacattccacgttctcttaaatagaagagagctcagtgctggcacatactcctgtgcttcctgaatgatttcctttagtagtaatgacatttctaacaaatgctttgttggaaatacccttgcatctaaccaagatataatcagttgttgaacttttgcctctcgttgtcttcttttcttttcttgcccactatatgtcacccatgccactaccctgtgggacctgttgtcgctcgatggctgagcctgcatagagttatttttaataaaatatatgttttctttcagcatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattct

SEQ ID NO: 312235 - DNA, 474 bp, Homo sapiens
ccccgactagcccgacaggcgcggtggtcggacgacagaccgtgtgtttccaaaatggcggcagcgatggatgtggataccccgagcggcaccaacagcggcgcgggcaagaagcgctttgaagtgaaaaaggcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattct

SEQ ID NO: 312236 - DNA, 656 bp, Homo sapiens
  misc_feature (538)..(538): n is a, c, g, or t
  misc_feature (543)..(543): n is a, c, g, or t
  misc_feature (568)..(568): n is a, c, g, or t
  misc_feature (572)..(572): n is a, c, g, or t
  misc_feature (575)..(575): n is a, c, g, or t
  misc_feature (592)..(592): n is a, c, g, or t
  misc_feature (594)..(594): n is a, c, g, or t
  misc_feature (606)..(606): n is a, c, g, or t
  misc_feature (611)..(611): n is a, c, g, or t
  misc_feature (613)..(613): n is a, c, g, or t
ccccgggctgcaggattcggcacgagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctaaaaaaaacaactgctttttttncctancattcagtgattactgtcaggctgntttncanacttggattttgacttngngctttagaaatncgggngnatgctgtgtccccgtgagcttaggggggttctggtggcgtacc

SEQ ID NO: 312237 - DNA, 256 bp, Homo sapiens
ccccgggctgcaggattcggcacgagacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattct

SEQ ID NO: 312238 - DNA, 600 bp, Homo sapiens
actggagttcaggtgaaaataggccgccatgatcagggcagcccgaaagttcaaactgtctgagcccctgttgggagtgagcaggcggagctccctttcacaaccaccaatgacttttccctctcacctccctaataccaccaggcagctactggcacctgtcaggtgggcatggttgagtcagagggagagcctgtccctaagagggggcagtaggcaagaagtcctgtaagatggggaggggaaaggggaatcacagcgacagccaagctagtgtcagtgtcgtcacctaatcctggagcacactgtgatcacttaggttctaactaaagttgcttatgtgtttaagcaggttttatgtctcaaacaggaaattatcttggaattaatcagagtaatttactttgtctttcaggtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattct

SEQ ID NO: 312239 - DNA, 889 bp, Homo sapiens
tggccaaagagatgataactgcagctgcagcctgaggtcctaaagagtatgtgtgtgtgttacaagcagaatgcactgttccctctttttgtctttgcagtggaatgcagtagccctctgggcctgggatattgtggttgataactgtgccatctgcaggaaccacattatggatctttgtaagtaattggaggaggatgggaggaagttgagaaggttgcagagattgtggctatcttgatgtgactgattttcttcttcacacgaggagatagcaagcctactctgagcactcggtcttctgtatctagtctgttggtgtgtttgaaatagagtagtttttttatgatgtcctggaggcatacccagctctcagaataaatctactcaatctaaagatggcagggacacatttagaattaattgtggacgacaggcactgttgatttttcctgcatatcttccatcttgtacctagactcaaaggtagaaatagtgaaaggagaattgcttgaacctgggaggcagaggtggcagtgagccgagatcacaccactgcactacaacctgggcgacacagcaagactcaaagtctcaaaaaaaaaaaaaagtctatctgatctaatttttgctggtcattgtttacaaaggaaagaagcgttaaggagtgaggattttgtatgttaggcccaaacataataaaaaggaaatcattgccaacatctaaataaataattaattgcactaaagaaatttcatttaaatctccacatattttattacatgtagtggtcagcacatagtgatctgattatagtctttgatgaactgatttcctgtccttacagtagaagggacaagaatgttgatcacaccaggaacagttgag

SEQ ID NO: 312240 - DNA, 609 bp, Homo sapiens
ccccgactagcccgacaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctaaaaaaaaaaaaaaaaacaaaaaaaaaaaaagaaaaaaaaaaaacaacaaagaaga

SEQ ID NO: 312241 - DNA, 606 bp, Homo sapiens
ccccgactagcccgacaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctcccggagcggccagacaacctaaataaaaaaggaagaaaaatataaataatat

SEQ ID NO: 312242 - DNA, 634 bp, Homo sapiens
ccccgggctgcaggattcggcacgagcgatggatgtggataccccgagcggcaccaacagcggcgcgggcaagaagcgctttgaagtgaaaaaggttgggtctcgccagcgccttcctcagggaagctagagaggcgcggatctggctggcaggcccgaggatggtcgaggcgcggagtaaagggtttcatttcagggcgttcctgggaccggtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattct

SEQ ID NO: 312243 - DNA, 463 bp, Homo sapiens
gcgggagccaagcgcttgagctgtcactggagtggttgagagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattct

SEQ ID NO: 312244 - DNA, 691 bp, Homo sapiens
tgaggaagccagagttgaatgaatgaaattctgttaaactcttactggaattattatcttaatagaagagtctaaacatataaaagttgagaacatcagtttattttatgtggaatgcagtagccctctgggcctgggatattgtggttgataactgtgccatctgcaggaaccacattatggatctttagacgggatctcgctttgttgcccaggctggtctcgaactggcttcaagtgatcctcccactttggccttccaaaatgttgcgattataggcgtgagccactgtggctggcctgaaattttctagtatccacattcataaagtaaaaagaaaataaaaaggcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattct

SEQ ID NO: 312245 - DNA, 1559 bp, Homo sapiens
actggagttcaggtgaaaataggccgccatgatcagggcagcccgaaagttcaaactgtctgagcccctgttgggagtgagcaggcggagctccctttcacaaccaccaatgacttttccctctcacctccctaataccaccaggcagctactggcacctgtcaggtgggcatggttgagtcagagggagagcctgtccctaagagggggcagtaggcaagaagtcctgtaagatggggaggggaaaggggaatcacagcgacagccaagctagtgtcagtgtcgtcacctaatcctggagcacactgtgatcacttaggttctaactaaagttgcttatgtgtttaagcaggttttatgtctcaaacaggaaattatcttggaattaatcagagtaatttactttgtctttcaggtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctggaacggatgctctctcttgtgtatgtgaacaaagtgaacataaatgaagagtctccccttccaaggctgaaaactcagcttttgaaagtgaaatgtttgttcatcggggccagagcagggttgtcctctgagcgcatcacttagtgacgaggaatccaacagctcaaggcagagtgtggatcaccggctcccgaaaacagcagtcagcccttctttctcctgtgtgacagcagtgggcagctgaaagagggaagaatgtgggattcagtcatcaaacccagttctgagtcctggttccacagcttgggtactgatggcaatcttggccaagttgtctctctactctggaactttcctcctctgtactgtgggcttctgaggactaagtggcatcatgtgggcacagagagaagctttgtaaaatgtaaaaccgctatacaaatgtgacctttggttgtgtatgacagcagtccccaacctttttgccaccagggattggtttcatggaagacgatttttccatggaccgggggtggggcgggggtgtgcttggggatggttttggaactgttccacctgagatcatgaggcagtagatggaccgcgcaacctagatccctcacatgcacggttcgccaatagggttgaagctcctatgagaatctaacgctgccgctgatgtgacaggcagagctcaggcggtaatgctcggtcaccaccctgctcacctcttgctgtacagccgggttcctagcaggccatggactggcatccactccgcagctcaagggttagggaagcctggtgtatgacatgttgctttctcttcttagcttagaaaaataaagatatatataatcttggctggcaaagggacaatttaagaactcaagttaaaaattgatattggctgggtatggtggctcatgcctataatcaggcgattacaaggtgagga

SEQ ID NO: 312246 - DNA, 1512 bp, Homo sapiens
ccccgactagcccgacaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctggaacggatgctctctcttgtgtatgtgaacaaagtgaacataaatgaagagtctccccttccaaggctgaaaactcagcttttgaaagtgaaatgtttgttcatcggggccagagcagggttgtcctctgagcgcatcacttagtgacgaggaatccaacagctcaaggcagagtgtggatcaccggctcccgaaaacagcagtcagcccttctttctcctgtgtgacagcagtgggcagctgaaagagggaagaatgtgggattcagtcatcaaacccagttctgagtcctggttccacagcttgggtactgatggcaatcttggccaagttgtctctctactctggaactttcctcctctgtactgtgggcttctgaggactaagtggcatcatgtgggcacagagagaagctttgtaaaatgtaaaaccgctatacaaatgtgacctttggttgtgtatgacagcagtccccaacctttttgccaccagggattggtttcatggaagacgatttttccatggaccgggggtggggcgggggtgtgcttggggatggttttggaactgttccacctgagatcatgaggcagtagatggaccgcgcaacctagatccctcacatgcacggttcgccaatagggttgaagctcctatgagaatctaacgctgccgctgatgtgacaggcagagctcaggcggtaatgctcggtcaccaccctgctcacctcttgctgtacagccgggttcctagcaggccatggactggcatccactccgcagctcaagggttagggaagcctggtgtatgacatgttgctttctcttcttagcttagaaaaataaagatatatataatcttggctggcaaagggacaatttaagaactcaagttaaaaattgatattggctgggtatggtggctcatgcctataatcaggcgattacaaggtgagga

SEQ ID NO: 312247 - DNA, 553 bp, Homo sapiens
ccccgactagcccgacaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattct

SEQ ID NO: 312248 - DNA, 713 bp, Homo sapiens
ccccgactagcccgacaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttagacgggatctcgctttgttgcccaggctggtctcgaactggcttcaagtgatcctcccactttggccttccaaaatgttgcgattataggcgtgagccactgtggctggcctgaaattttctagtatccacattcataaagtaaaaagaaaataaaaaggcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattct

SEQ ID NO: 312249 - DNA, 955 bp, Homo sapiens
  misc_feature (659)..(659): n is a, c, g, or t
  misc_feature (720)..(720): n is a, c, g, or t
ccccgactagcccgacaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaaccatgcttttcacttccactgcatctctcgctggctcaaaacacgacaggtgtgtccattggacaacagagagtgggaattccaaaagtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattctaaaaaaaaaaaaaaaaacaaaaaaaaaaaaattgcgggggcatttatgggcgggggggggaaaaaggggtaatgaaaggggccaaggggccaaacgcgtgtcccgngacccagtttccttgtgcacagagggggaaaactcggcggggacccccaaaagggagcgcngaatataaatcggaaaacccgggtaaccgggattagacaccatcagaacacgaaaggacccaccacacagcgcaggacacagagagagagaagaaaaaaacaaacagagagagcacaaaagcagagcacagaaaaaacaataacaatagagagaccaacacacaaaacgagcagacagaacagaaaacaacaagacatacacaacacagagaaaaaaaaaaaacaacaaagaaga

SEQ ID NO: 312250 - DNA, 467 bp, Homo sapiens
ccccgactagcccgacaggcgcggtggtcggacgacagaccgtgtgtttccaaaatggcggcagcgatggatgtggataccccgagcggcaccaacagcggcgcgggcaagaagcgctttgaagtgaaaaagtggaatgcagtagccctctgggcctgggatattgtggttgataactgtgccatctgcaggaaccacattatggatctttgcatagaatgtcaagctaaccaggcgtccgctacttcagaagagtgtactgtcgcatggggagtctgtaacgtatgggcactaggaaaagacttcttccatcaagcttaattgttttgttattcatttaatgactttccctgctgttacctaattacaaattggatggaactgtgtttttttctgctttgttttttcagtttgctgtttctgtagccatattgtattctgtgtcaaataaagtccagttggattct

SEQ ID NO: 312251 - DNA, 1544 bp, Homo sapiens
gtgacgtcgtggcgggtcactcactcggggatcgccgattgcgatcgtaggggtcttccttctctaacttgcctccaggagagaggacctggcctgcgctgctaatgggtagtccgttcgcagcaggaccagccctggcctaaggaaacaggaaagagtttgagacttccttctaaaggagccacgtttgagaaatgggatgcaggcctaagttaagaatgctacagaaaaatatcgatccctaagcgtatttactgttatgtgaatgtgtgtgtcaaaggacttaggtgctttgggggagaggagggtgaagacaggaatttattcattgagcgaatagttattaagcgcccactctattccagacaccgttctaggcattaggtgaacagcagtgaacaaaacagacggaaatctgtgtctacttgtagctcacattttagagaggaaggcacatactaagcaaagtaattagaaacatactgtattttaggtcgtgatagtcctgaagagaaacgtaaagcagggaagaagggtataaagtgacacaggaaggtcttgctgaaaagatgacttttaagtaaagggctgacagaagtgggagatttaaccacgcgaatatcttgggaaagtgcagtcagacagagggaccagccattgcagaggtcatgaagcagaaacgtgctagaatagcaaggaggcctgtagggcagagttgagtgaagggtttagtccttcactggagattaaatcaaggcgagcaggtcatgaagatcttgaggacatctaacttttattctaaatgaaataggactttggagcgttttgagcagtagagtgatgggctctgacttccttttaagagggtcactctttaaggaaaatacacagaggaggacgtggtaggagaaaggagaccaataagaagagttttgcaataatccagaggaagcataatggtggtttgactatgggtggtaagaaatggccagttatattcttgatgcacttaatttggatatgtaagagtattatagatgacagggttaattttatttaattaggctttggaggacacttgaaaaatgaattccagtgtgagtttcagagtggcaaacacaagttaaaatcatggctttgctatgtggtacttgaagggattcagataagtcatgtaattttcctggatctgtctataaaatggaaatcatatctgtcaagattgcaaaggttagggtatattataggtatttaatgacaaggtatgtaatgggtctagtctgcaaatcttaaccaggtaaaagatggccttattgtgaggtaagagggtcatgggaggccaaggcatactcctttttaaattttatggactctttactggggaggaaagtttttgtgttaatgacgatggtatttagaaatgcatggactggcctctcatagctgtccaccctatagtcattccttatagccatcctttaaaccctccaggaccccctatgtcctcatcagtaaagggaaagcaggctgtctggtaagggaaa

SEQ ID NO: 312252 - DNA, 2583 bp, Homo sapiens
ctgctatagtacgcgggtggctggacctacatgcttcctgctgtggctgtctcggaacccgtggtcctccgcttcatgattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaagcagctatcctttttttttttaattctagcttctttttaaagattatttgggtacctaataaaggataatttatatctttattacagactgatattttgctttttcatgtgtcatcatactgtcagtatattaaaagaaattacagcctaaaacttaacatataccatacatatatattaaggtgtcaaatagctattctcactcatcttacaaatattgtaagagcaataaaaattaattgaggaattataagcctacaggtcatcagccttgaggtgattactgatgatttgggcttacacacatgtcagcaagatagggagtgtggataggggagggctggtagctaacaaggggcctcacagagaaatattagtgactttaaccaggtttcagaatctgggccttacctttacaggttcaacaaaagaatggcatcaatagaggcagaagtatagacattgttttaaaaatacacacatgcacacacacacaaaacattttagcattatagctgtctgaatccttcaataagaaggagaggcacacacaaatacacacactcacacaaaactcaacaaccataaaacaaccctgcatgttataaaaggcagaattaaattttatttatttaaatccatggaactctggtaggccaggatatattatagtaccattatcaatgtgatattctgaaaatatgaactgagcgtcattaacaattgttggtacctaaacacaaaatgaatttcaaaagttactttgttctcaagatatgtcattcttttgggaataaatacttctggtgacaaaaaaaaaaa

SEQ ID NO: 312253 - DNA, 1840 bp, Homo sapiens
ctgctatagtacgcgggtggctggacctacatgcttcctgctgtggctgtctcggaacccgtggtcctccgcttcatgattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaagcagctatcctttttttttttaattctagcttctttttaaagattatttgggtacctaataaaggataatttatatctt

SEQ ID NO: 312254 - DNA, 2390 bp, Homo sapiens
gtgacgtcgtggcgggtcactcactcggggatcgccgattgcgatcgtaggggtcttccttctctaacttgcctccaggagagaggacctggcctgcgctgctaatgggtagtccgttcgcagcaggaccagccctggcctaaggaaacaggaaagagtttgagacttccttctaaaggagccacgtttgagaaatgggatgcaggcctaagattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaagcagctatcctttttttttttaattctagcttctttttaaagattatttgggtacctaataaaggataatttatatctttattacagactgatattttgctttttcatgtgtcatcatactgtcagtatattaaaagaaattacagcctaaaacttaacatataccatacatatatattaaggtgtcaaatagctattctcactcatcttacaaatattgtaagagcaataaaaattaattgaggaattataagcctacaggtcatcagccttgaggtgattactgatgatttgggcttacacacatgtcagcaagatagggagtgtggataggggagggctggtagctaacaaggggcctcacagagaaatattagtgactttaaccaggtttcagaatctgggccttacctttacaggttcaacaaaagaatggcatcaatagaggcagaagtatagacattgttttaaaaatacacacatgcacacacacacaaaacattttagcattatagctgtctgaatccttcaataagaaggagaggcacacacaaatacacacactcacacaaaactcaacaaccataaaacaaccctgcatgttataaaaggcagaattaaattttatttatttaaatccatggaactctggtaggccaggatatattatagtaccattatcaatgtgatattctgaaaatatgaactgagcgtcattaacaattgttggtacctaaacacaaaatgaatttcaaaagttactttgttctcaagatatgtcattcttttgggaataaatacttctggtgacaaaaaaaaaaa

SEQ ID NO: 312255 - DNA, 3527 bp, Homo sapiens
cacgaggagttgtgagatatttgtcattgcccacacttacacccacttagtcataacttaatcttgtcattatttcagttgagttatatatgcactattggcatatagttgttgagtgtaatttcccttttaaagatcatttagaagattatgattagcattagaatgaaaagttactgtgtatgtggggaaacaaagggtgatacaagataaaaatccagggctaaatttaaaagaagtctgtcaataaataatataggatgtgtctaagtaataagaaagcattgggtcagttgattcaatagtgttttttttcataatgtacataaaataatagagcttcttgggattgaagccattttacaattgatggcattttagatttcttgtatagtatttaaagcttccaacaaaaatgtaaatttttacctactgtaattctgaaatagggaaattagaggttttgagtagagacactttcaaatttgtgtagcgttcctatatagcataagaattctaaaattaaaagtctgcctgtaaaactttgatttcaaagtagtaacttacttatgtttgattcccaatgttgtcatcgtggggcagagattttgctttttcaaaaagattgcaggcaatttagatggtgtgggtggggaggactactgaggaaattgctcagtaaacaaaaatgatagtgaagatctcagaatctcaaaaatcatcttttgtgtgtgtattttaatgattaagatgtactataaattcatgtacagtatttgggattctgcattagaggcatcgtatgattaatggctttttaggtttgatgaagtatgataattaacattgagaaggacaaaattaatgtgaagggacagaatgatttagataatatgtttcaaaagcttttgtcctaaaaaatgcattattaccattttaatttagtaaaggaaaaagaaaaggtcttgatcctcaccaaacacaattaacatacttggtctacagttttctgtgcttctctcttcataaatgttttatattttcaattactgtgcatgtcattcttatatctattttaatctcacagtcttaatttttttacattttagtccagagacttaaactagcatttcctaaactgttttagagaatactagttcaaataaatgttaatagctgttcctgtgttaggattctgtcattaaatatattggaaaatgcttcgtaattatatcctttagagaaattatagctagagcattaaaagagctaactgcagcatcagacagacctgagtttcaatcctcgtttactatgtattacatgaggcaaattaattttaattcaagttttcttctctgtataatggagattattacagtattcgaaattgacttgtgtaaagcatttagccagccatagcgcatgttctacaaatatatgtagttgttattatcatctatgagaaactttatacatattagaaactctgaggatttaaaattttgaaggttgacttatactcaatgtaaaattgaaaaatcacaggggagtaattagcatagagattaatgaaatgagcactgggttgaatggtaaaagatttgtttgagctttaagcagtattgttgttaaactatcactgtgccctaagcgtaacattattttaaaaatgtcttcaactgtgtttcccccatttgtctgaaagcttagttagttcaaagaacatgtttatttttgttctctactataaacccagcacatgacacaaaatcagggagtgtaaagttggggtcatgaacttattttaggagcctggtaggtaatataaatggcagacaacagggagtagtaaagtgtctgtctgtcttacttaaagacattcacatcagttatttccaacactgttagccctggaaaagaaagctatccctgaactttgtcaggctagtttgtgatccctagaaaagattagtgattaagaccaaaccctgaagaacagcatcattaatgggacagattaaaaaaaaaaggagccctgaaaggaggtgacaaggaagtaggaggtgaaatcaggtacaagtaattttttaaattaagaaaagtatagccctctccctctccctctccctctccgcaccgtctccctctgatgccgagccgaggctggactgtactgccaccatcttgactcactgcaacctccctgcctgattctcctgcctcagtctgccgagttcctgggattgcaggtgcgcgccgccactcctgactggtttttgtattttttggtggagacggggtttcaccgtgttggccgggctggtctccagctcctgaccgcgagtgatctgccagcctcggcgtcctgaggtgccgggattgcagacggagtctcgctcactcagtgctcaatgttgcccatgctggagtgcagtggcgtgatcttggctcgctacaacctccacctcccagccgcctgccttggcctcccaaagtgccgagattgcagcctctgcccggccgccaccccgtctaggaagtgaggagcgtctttgcctggccgcccatcgtcggggatgtgaggagcccctctgcccggccgcccagtctgggaagtgaggagcacctcttcccggccgtcatcctgtctaggaagtgaggagcgtctctgcccagccgcccatcatctgggatgtggggagcatctctgccccgtcgccccgtctgagatgtgaagagcgcctctgcccggccgcgaccctgtctgggaactgaggagtgtctctgccccgccgccaccccgtctgggaggattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttataccta

SEQ ID NO: 312256 - DNA, 820 bp, Homo sapiens
gatcctgatcagagcatacccctctagcttctttttaaagattatttgggtacctaataaaggataatttatatctttattacagactgatattttgctttttcatgtgtcatcatactgtcagtatattaaaagaaattacagcctaaaacttaacatataccatacatatatattaaggtgtcaaatagctattctcactcatcttacaaatattgtaagagcaataaaaattaattgaggaattataagcctacaggtcatcagccttgaggtgattactgatgatttgggcttacacacatgtcagcaagatagggagtgtggataggggagggctggtagctaacaaggggcctcacagagaaatattagtgactttaaccaggtttcagaatctgggccttacctttacaggttcaacaaaagaatggcatcaatagaggcagaagtatagacattgttttaaaaatacacacatgcacacacacacaaaacattttagcattatagctgtctgaatccttcaataagaaggagaggcacacacaaatacacacactcacacaaaactcaacaaccataaaacaaccctgcatgttataaaaggcagaattaaattttatttatttaaatccatggaactctggtaggccaggatatattatagtaccattatcaatgtgatattctgaaaatatgaactgagcgtcattaacaattgttggtacctaaacacaaaatgaatttcaaaagttactttgttctcaagatatgtcattcttttgggaataaatacttctggtgacaaaaaaaaaaa

SEQ ID NO: 312257 - DNA, 1117 bp, Homo sapiens
ctgctatagtacgcgggtggctggacctacatgcttcctgctgtggctgtctcggaacccgtggtcctccgcttcatgattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttataccta

SEQ ID NO: 312258 - DNA, 1761 bp, Homo sapiens
ctgctatagtacgcgggtggctggacctacatgcttcctgctgtggctgtctcggaacccgtggtcctccgcttcatgattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaa

SEQ ID NO: 312259 - DNA, 5320 bp, Homo sapiens
cacgaggagttgtgagatatttgtcattgcccacacttacacccacttagtcataacttaatcttgtcattatttcagttgagttatatatgcactattggcatatagttgttgagtgtaatttcccttttaaagatcatttagaagattatgattagcattagaatgaaaagttactgtgtatgtggggaaacaaagggtgatacaagataaaaatccagggctaaatttaaaagaagtctgtcaataaataatataggatgtgtctaagtaataagaaagcattgggtcagttgattcaatagtgttttttttcataatgtacataaaataatagagcttcttgggattgaagccattttacaattgatggcattttagatttcttgtatagtatttaaagcttccaacaaaaatgtaaatttttacctactgtaattctgaaatagggaaattagaggttttgagtagagacactttcaaatttgtgtagcgttcctatatagcataagaattctaaaattaaaagtctgcctgtaaaactttgatttcaaagtagtaacttacttatgtttgattcccaatgttgtcatcgtggggcagagattttgctttttcaaaaagattgcaggcaatttagatggtgtgggtggggaggactactgaggaaattgctcagtaaacaaaaatgatagtgaagatctcagaatctcaaaaatcatcttttgtgtgtgtattttaatgattaagatgtactataaattcatgtacagtatttgggattctgcattagaggcatcgtatgattaatggctttttaggtttgatgaagtatgataattaacattgagaaggacaaaattaatgtgaagggacagaatgatttagataatatgtttcaaaagcttttgtcctaaaaaatgcattattaccattttaatttagtaaaggaaaaagaaaaggtcttgatcctcaccaaacacaattaacatacttggtctacagttttctgtgcttctctcttcataaatgttttatattttcaattactgtgcatgtcattcttatatctattttaatctcacagtcttaatttttttacattttagtccagagacttaaactagcatttcctaaactgttttagagaatactagttcaaataaatgttaatagctgttcctgtgttaggattctgtcattaaatatattggaaaatgcttcgtaattatatcctttagagaaattatagctagagcattaaaagagctaactgcagcatcagacagacctgagtttcaatcctcgtttactatgtattacatgaggcaaattaattttaattcaagttttcttctctgtataatggagattattacagtattcgaaattgacttgtgtaaagcatttagccagccatagcgcatgttctacaaatatatgtagttgttattatcatctatgagaaactttatacatattagaaactctgaggatttaaaattttgaaggttgacttatactcaatgtaaaattgaaaaatcacaggggagtaattagcatagagattaatgaaatgagcactgggttgaatggtaaaagatttgtttgagctttaagcagtattgttgttaaactatcactgtgccctaagcgtaacattattttaaaaatgtcttcaactgtgtttcccccatttgtctgaaagcttagttagttcaaagaacatgtttatttttgttctctactataaacccagcacatgacacaaaatcagggagtgtaaagttggggtcatgaacttattttaggagcctggtaggtaatataaatggcagacaacagggagtagtaaagtgtctgtctgtcttacttaaagacattcacatcagttatttccaacactgttagccctggaaaagaaagctatccctgaactttgtcaggctagtttgtgatccctagaaaagattagtgattaagaccaaaccctgaagaacagcatcattaatgggacagattaaaaaaaaaaggagccctgaaaggaggtgacaaggaagtaggaggtgaaatcaggtacaagtaattttttaaattaagaaaagtatagccctctccctctccctctccctctccgcaccgtctccctctgatgccgagccgaggctggactgtactgccaccatcttgactcactgcaacctccctgcctgattctcctgcctcagtctgccgagttcctgggattgcaggtgcgcgccgccactcctgactggtttttgtattttttggtggagacggggtttcaccgtgttggccgggctggtctccagctcctgaccgcgagtgatctgccagcctcggcgtcctgaggtgccgggattgcagacggagtctcgctcactcagtgctcaatgttgcccatgctggagtgcagtggcgtgatcttggctcgctacaacctccacctcccagccgcctgccttggcctcccaaagtgccgagattgcagcctctgcccggccgccaccccgtctaggaagtgaggagcgtctttgcctggccgcccatcgtcggggatgtgaggagcccctctgcccggccgcccagtctgggaagtgaggagcacctcttcccggccgtcatcctgtctaggaagtgaggagcgtctctgcccagccgcccatcatctgggatgtggggagcatctctgccccgtcgccccgtctgagatgtgaagagcgcctctgcccggccgcgaccctgtctgggaactgaggagtgtctctgccccgccgccaccccgtctgggaggattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaagcagctatcctttttttttttaattctagcttctttttaaagattatttgggtacctaataaaggataatttatatctttattacagactgatattttgctttttcatgtgtcatcatactgtcagtatattaaaagaaattacagcctaaaacttaacatataccatacatatatattaaggtgtcaaatagctattctcactcatcttacaaatattgtaagagcaataaaaattaattgaggaattataagcctacaggtcatcagccttgaggtgattactgatgatttgggcttacacacatgtcagcaagatagggagtgtggataggggagggctggtagctaacaaggggcctcacagagaaatattagtgactttaaccaggtttcagaatctgggccttacctttacaggttcaacaaaagaatggcatcaatagaggcagaagtatagacattgttttaaaaatacacacatgcacacacacacaaaacattttagcattatagctgtctgaatccttcaataagaaggagaggcacacacaaatacacacactcacacaaaactcaacaaccataaaacaaccctgcatgttataaaaggcagaattaaattttatttatttaaatccatggaactctggtaggccaggatatattatagtaccattatcaatgtgatattctgaaaatatgaactgagcgtcattaacaattgttggtacctaaacacaaaatgaatttcaaaagttactttgttctcaagatatgtcattcttttgggaataaatacttctggtgacaaaaaaaaaaa

SEQ ID NO: 312260 - DNA, 2717 bp, Homo sapiens
gtgacgtcgtggcgggtcactcactcggggatcgccgattgcgatcgtaggggtcttccttctctaacttgcctccaggagagaggacctggcctgcgctgctaatgggtagtccgttcgcagcaggaccagccctggcctaaggaaacaggaaagagtttgagacttccttctaaaggagccacgtttgagaaatgggatgcaggcctaagattttctgccgtctcttggcaaaaatggcaaataatgatgctgttctgaagagactggagcagaagggtgcagaggcagatcaaatcattgaatatcttaagcagcaagtttctctacttaaggagaaagcaattttgcaggcaactttgagggaagagaagaaacttcgagttgaaaatgctaaactgaagaaagaaattgaagaactgaaacaagagctaattcaggcagaaattcaaaatggagtgaagcaaataccatttccatctggtactccactgcacgctaattctatggtttctgaaaatgtgatacagtctacagcagtaacaaccgtatcttctggtaccaaagaacagataaaaggaggaacaggagacgaaaagaaagcgaaagagaaaattgaaaagaaaggagagaagaaggagaaaaaacagcaatcaatagctggaagtgccgactctaagccaatagatgtttcccgtctggatcttcgaattggttgcatcataactgctagaaaacaccctgatgcagattctttgtatgtggaagaagtagatgtcggagaaatagccccaaggacagttgtcagtggcctggtgaatcatgttcctcttgaacagatgcaaaatcggatggtgattttactttgtaacctgaaacctgcaaagatgaggggagtattatctcaagcaatggtcatgtgtgctagttcaccagagaaaattgaaatcttggctcctccaaatgggtctgttcctggagacagaattacttttgatgctttcccaggagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaagcagctatcctttttttttttaattctagcttctttttaaagattatttgggtacctaataaaggataatttatatctttattacagactgatattttgctttttcatgtgtcatcatactgtcagtatattaaaagaaattacagcctaaaacttaacatataccatacatatatattaaggtgtcaaatagctattctcactcatcttacaaatattgtaagagcaataaaaattaattgaggaattataagcctacaggtcatcagccttgaggtgattactgatgatttgggcttacacacatgtcagcaagatagggagtgtggataggggagggctggtagctaacaaggggcctcacagagaaatattagtgactttaaccaggtttcagaatctgggccttacctttacaggttcaacaaaagaatggcatcaatagaggcagaagtatagacattgttttaaaaatacacacatgcacacacacacaaaacattttagcattatagctgtctgaatccttcaataagaaggagaggcacacacaaatacacacactcacacaaaactcaacaaccataaaacaaccctgcatgttataaaaggcagaattaaattttatttatttaaatccatggaactctggtaggccaggatatattatagtaccattatcaatgtgatattctgaaaatatgaactgagcgtcattaacaattgttggtacctaaacacaaaatgaatttcaaaagttactttgttctcaagatatgtcattcttttgggaataaatacttctggtgacaaaaaaaaaaa

SEQ ID NO: 312261 - DNA, 1869 bp, Homo sapiens
tcatgaactaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagagagcctgacaaggagctgaatcctaagaagaagatttgggagcagatccagcctgatcttcacactaatgatgagtgtgtggctacatacaaaggagttccctttgaggtgaaagggaagggagtatgtagggctcaaaccatgagcaacagtggaatcaaataaaatgcttccactaccaaaagacattagagaaaaccttaaaagtaataaagagaaatatatttgtcacttatacctaaaatatgagtggctcatttttgcattactctcttctagacttgactagtcatttacttggtatatattgttttcattgattggggaaacactagatttttacctcggtttttgatcatttataatggagagaggaagttgcctatgttttgtaataatttattttttagcaggaatattgattagcagcttttttttctttatacacatagataactaactagattaatgtttagtttcttatttgtaggcacaggatgcatgaaatttcaagctctgggattttttgtatattgtgtatctgtatcaaaaatatcctctccttttcaaaaatgacaggttggaaaatgtttgtcagacttattaactggtcatattataataatactgataatgaccaactgctcattctgaaagccaaacataaaagctaggagaagtggcatctgaacatttttgctttgctgccagagtaaccctgactaataatacaataacagcaatttttttaaaaaactgagatttcctactggcttgaagtttttctatttagcaaaataattagtaataagttttgactaggtctaaagaatgaacacattgtaaacagttgccacagtagtttctaataaattgatcataaaagcagctatcctttttttttttaattctagcttctttttaaagattatttgggtacctaataaaggataatttatatctttattacagactgatattttgctttttcatgtgtcatcatactgtcagtatattaaaagaaattacagcctaaaacttaacatataccatacatatatattaaggtgtcaaatagctattctcactcatcttacaaatattgtaagagcaataaaaattaattgaggaattataagcctacaggtcatcagccttgaggtgattactgatgatttgggcttacacacatgtcagcaagatagggagtgtggataggggagggctggtagctaacaaggggcctcacagagaaatattagtgactttaaccaggtttcagaatctgggccttacctttacaggttcaacaaaagaatggcatcaatagaggcagaagtatagacattgttttaaaaatacacacatgcacacacacacaaaacattttagcattatagctgtctgaatccttcaataagaaggagaggcacacacaaatacacacactcacacaaaactcaacaaccataaaacaaccctgcatgttataaaaggcagaattaaattttatttatttaaatccatggaactctggtaggccaggatatattatagtaccattatcaatgtgatattctgaaaatatgaactgagcgtcattaacaattgttggtacctaaacacaaaatgaatttcaaaagttactttgttctcaagatatgtcattcttttgggaataaatacttctggtgacaaaaaaaaaaa

SEQ ID NO: 312262 - DNA, 1056 bp, Homo sapiens
ggaaaactagctgcatcatttgcagagtccagtacaaaatgaaaatgtggaggccttgttcaaaaattttagggatattggccaggcacggtggctcacgcctgtaatcccagcacttcgggaggccaaggtgggtggatcacgaggtcaagagatcaagaccagcctggccaacatggtgaaaccctgtctctactaaaaatacaaaacttagctgggcctagcggtgcatgcctgtagtcccagctactcgggagactgaggcaggagaatcgcttgaaccagggaggtggagttgtagtgagtcgagatcgcaccactgcactccagcctggtgacagagtgagactctgtctcaaaaaaaaaaaaaaaaaatttccaaggatttcaagatggcaacgcagagcacagaccctgcataatcccttctgagctcagagctgcacgcctgtaaagccagtcctattggaggggcaggtggagcctgtaacacactgcctcttcttcccttgctttctttcctaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctgctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312263 - DNA, 729 bp, Homo sapiens
accctccatcatcctacaacccacaccaccccacctccaccactcctatcaccctcacccatccacccgaaaatgctaacatacacacgcacccagccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaaaaaaaaccctaatacacgcccaccgaccacgaaaccgcccaccagacacagtcctcagcacagatcactacacactctaacaccccccatcgaaccagaccaca

SEQ ID NO: 312264 - DNA, 1867 bp, Homo sapiens
aagcgctggtacggcccgggattatggtatctgagggaggcaggggaatgagccaggctggagctgagccagcagggcagggcccccctgctgcgacagtggcatcctgatagtgagatgctcagatgctgctgccctctagtggccgccagttccctgcaactcagaccacgtgatttctgggaaaaggccctccctggaggagaactgaaacttagggtggggactgtagaaaggggcggagagatcagccgcccagccaggagttaagctgaggtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312265 - DNA, 2346 bp, Homo sapiens
aagcgctggtacggcccgggattatggtatctgagggaggcaggggaatgagccaggctggagctgagccagcagggcagggcccccctgctgcgacagtggcatcctgatagtgagatgctcagatgctgctgccctctagtggccgccagttccctgcaactcagaccacgtgatttctgggaaaaggccctccctggaggagaactgaaacttagggtggggactgtagaaaggggcggagagatcagccgcccagccaggagttaagctgaggtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccaggtacgtggcatttctgactttctcctgtgccctgtgcccctgaggtcttccacctttgactatgcatgcattatctagtcagtcagggcttacagcaaactgtacccacattaccatagccctaggcagtggtttctaggtggcgagaattccatatgcctggccagactccaaaaagcttgcttcccaaaaataccaccctatacactctcctggaaatctacattgagacattgatttcattgggccaaacagaggcccaatctcaagggaccttctagtaaactacaagcccctgggcattgagccctgaggcctcatggtgaatcacatactagctacttgcctcagtgataggaaaacctgagaggaagccccctggctggtgtggggaggggaggtggagttgttcccctggggaggggctgctgccagcctgcatgctcctccagcaccaggtagggctgttctatccccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312266 - DNA, 1525 bp, Homo sapiens
aagcgctggtacggcccgggattatggtatctgagggaggcaggggaatgagccaggctggagctgagccagcagggcagggcccccctgctgcgacagtggcatcctgatagtgagatgctcagatgctgctgccctctagtggccgccagttccctgcaactcagaccacgtgatttctgggaaaaggccctccctggaggagaactgaaacttagggtggggactgtagaaaggggcggagagatcagccgcccagccaggagttaagctgaggtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312267 - DNA, 1897 bp, Homo sapiens
ggaaaactagctgcatcatttgcagagtccagtacaaaatgaaaatgtggaggccttgttcaaaaattttagggatattggccaggcacggtggctcacgcctgtaatcccagcacttcgggaggccaaggtgggtggatcacgaggtcaagagatcaagaccagcctggccaacatggtgaaaccctgtctctactaaaaatacaaaacttagctgggcctagcggtgcatgcctgtagtcccagctactcgggagactgaggcaggagaatcgcttgaaccagggaggtggagttgtagtgagtcgagatcgcaccactgcactccagcctggtgacagagtgagactctgtctcaaaaaaaaaaaaaaaaaatttccaaggatttcaagatggcaacgcagagcacagaccctgcataatcccttctgagctcagagctgcacgcctgtaaagccagtcctattggaggggcaggtggagcctgtaacacactgcctcttcttcccttgctttctttcctaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312268 - DNA, 1324 bp, Homo sapiens
  misc_feature (12)..(12): n is a, c, g, or t
atcggctcggtnccgaatctcgacagttgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312269 - DNA, 1638 bp, Homo sapiens
aggctggtaccggccccagtcgttttgatgccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagcaccaggtagggctgttctatccccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312270 - DNA, 2163 bp, Homo sapiens
aagcgctggtacggcccgggattatggtatctgagggaggcaggggaatgagccaggctggagctgagccagcagggcagggcccccctgctgcgacagtggcatcctgatagtgagatgctcagatgctgctgccctctagtggccgccagttccctgcaactcagaccacgtgatttctgggaaaaggccctccctggaggagaactgaaacttagggtggggactgtagaaaggggcggagagatcagccgcccagccaggagttaagctgaggtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccaggtacgtggcatttctgactttctcctgtgccctgtgcccctgaggtcttccacctttgactatgcatgcattatctagtcagtcagggcttacagcaaactgtacccacattaccatagccctaggcagtggtttctaggtggcgagaattccatatgcctggccagactccaaaaagcttgcttcccaaaaataccaccctatacactctcctggaaatctacattgagacattgatttcattgggccaaacagaggcccaatctcaagggaccttctagtaaactacaagcccctgggcattgagccctgaggcctcatggtgaatcacatactagctacttgcctcagtgataggaaaacctgagaggaagccccctggctggtgtggggaggggaggtggagttgttcccctggggaggggctgctgccagcctgcatgctcctccagcaccaggtagggctgttctatccccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagatcctccatgtagcctatgcatggcactcctgcgcttgtgtgttgcatatcctgtgtggccatatgcccagcctggcagctacctggcagctctcctccagccaagacaatggaagaggtggttcaggtagagcccagcacaagagtgtcatatcttggagaacaccatcacactgaagcatgcagtcactatgtgaaggtgcacagaagaattggcacagagattttgagcctcatggccttctcctacgtacacacatttgggagagctggcacacatcacacacactggccctgggtgcaccgtctttaccacactccaggcatgccttagggttgcgcttctctcccatccaattccagctcctactcaattct

SEQ ID NO: 312271 - DNA, 950 bp, Homo sapiens
ttgagtgatcccaactcagggcgagctgcagctcaggagcgagctgcactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312272 - DNA, 814 bp, Homo sapiens
gttgacatgatagaatcgagccggtaccaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312273 - DNA, 557 bp, Homo sapiens
ctctagaggtcactaaactgagtggtacccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312274 - DNA, 478 bp, Homo sapiens
tgaggctgttctctctgggcacatgagcttccaccccctacctcttagtaccccctgggcccaacttgttgggtcctgctacctccctatctgccagcagatcctccatgtagcctatgcatggcactcctgcgcttgtgtgttgcatatcctgtgtggccatatgcccagcctggcagctacctggcagctctcctccagccaagacaatggaagaggtggttcaggtagagcccagcacaagagtgtcatatcttggagaacaccatcacactgaagcatgcagtcactatgtgaaggtgcacagaagaattggcacagagattttgagcctcatggccttctcctacgtacacacatttgggagagctggcacacatcacacacactggccctgggtgcaccgtctttaccacactccaggcatgccttagggttgcgcttctctcccatccaattccagctcctactcaattct

SEQ ID NO: 312275 - DNA, 2078 bp, Homo sapiens
aagcgctggtacggcccgggattatggtatctgagggaggcaggggaatgagccaggctggagctgagccagcagggcagggcccccctgctgcgacagtggcatcctgatagtgagatgctcagatgctgctgccctctagtggccgccagttccctgcaactcagaccacgtgatttctgggaaaaggccctccctggaggagaactgaaacttagggtggggactgtagaaaggggcggagagatcagccgcccagccaggagttaagctgaggtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaaacatgcaggcaagcaggacttccgggaggaccaggatgctgccttcttcaaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaaaaaaaaaaaaaaaaaaaaaaaaaaaaaaaataacaaaaacaaaaaaaaaaaataaaaaaaaaaaactttggggggggcccgggtccaatattcccttatagggaggcgaattccaattcaatggccgacttttcccaatgcgcgactggaaaacccttgcgttccccaagttattcgcttggcagacaatccccgttttgcccgtttggtg

SEQ ID NO: 312276 - DNA, 1686 bp, Homo sapiens
aagcgctggtacggcccgggattatggtatctgagggaggcaggggaatgagccaggctggagctgagccagcagggcagggcccccctgctgcgacagtggcatcctgatagtgagatgctcagatgctgctgccctctagtggccgccagttccctgcaactcagaccacgtgatttctgggaaaaggccctccctggaggagaactgaaacttagggtggggactgtagaaaggggcggagagatcagccgcccagccaggagttaagctgaggtcgtctgagccctgcgacagcctggacagcaactcaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312277 - DNA, 1712 bp, Homo sapiens
tctagaggatcgttaaggtatgcctgcacaggaatcgtctctgtagccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccaggtacgtggcatttctgactttctcctgtgccctgtgcccctgaggtcttccacctttgactatgcatgcattatctagtcagtcagggcttacagcaaactgtacccacattaccatagccctaggcagtggtttctaggtggcgagaattccatatgcctggccagactccaaaaagcttgcttcccaaaaataccaccctatacactctcctggaaatctacattgagacattgatttcattgggccaaacagaggcccaatctcaagggaccttctagtaaactacaagcccctgggcattgagccctgaggcctcatggtgaatcacatactagctacttgcctcagtgataggaaaacctgagaggaagccccctggctggtgtggggaggggaggtggagttgttcccctggggaggggctgctgccagcctgcatgctcctccagcaccaggtagggctgttctatccccagactactcactgctgctcaccttcatctacaacgggcgcgtggtgggcgaggcccaggtgcaaagcctggattgccgccttgtggctgagccctcaggctctgagagcagcatggagcaggtgctgttccccaagcctggcccactggagcccacgcagcgcctgctgagccagcttgagaggggcatcctagtggccagcaacccccgaggcctcttcgtgcagcgcctttgccccatccccatctcctggaatgcaccccaggctccacctgggccaggcccgcatctgctgcccagcaacgagtgcgtggagctcttcagaaccgcctacttctgcagagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312278 - DNA, 1555 bp, Homo sapiens
ggaaaactagctgcatcatttgcagagtccagtacaaaatgaaaatgtggaggccttgttcaaaaattttagggatattggccaggcacggtggctcacgcctgtaatcccagcacttcgggaggccaaggtgggtggatcacgaggtcaagagatcaagaccagcctggccaacatggtgaaaccctgtctctactaaaaatacaaaacttagctgggcctagcggtgcatgcctgtagtcccagctactcgggagactgaggcaggagaatcgcttgaaccagggaggtggagttgtagtgagtcgagatcgcaccactgcactccagcctggtgacagagtgagactctgtctcaaaaaaaaaaaaaaaaaatttccaaggatttcaagatggcaacgcagagcacagaccctgcataatcccttctgagctcagagctgcacgcctgtaaagccagtcctattggaggggcaggtggagcctgtaacacactgcctcttcttcccttgctttctttcctaggcctgggcaatatttaagggaaagtataaggagggggacacaggaggtccagctgtctggaagactcgcctgcgctgtgcactcaacaagagttctgaatttaaggaggttcctgagaggggccgcatggatgttgctgagccctacaaggtgtatcagttgctgccaccaggaatcgtctctggccagccagggactcagaaagtaccatcaaagcgacagcacagttctgtgtcctctgagaggaaggaggaagaggatgccatgcagaactgcacactcagtccctctgtgctccaggactccctcaataatgaggaggagggggccagtgggggagcagtccattcagacattgggagcagcagcagcagcagcagccctgagccacaggaagttacagacacaactgaggccccctttcaaggggatcagaggtccctggagtttctgcttcctccagagccagacttggtcaggtactttcagggcctgggccccccaccgaagttccaggtaacactgaatttctgggaagagagccatggctccagccatactccacagaatcttatcacagtgaagatggagcaggcctttgcccgatacttgctggagcagactccagagcagcaggcagccattctgtccctggtgtagagcctgggggacccatcttccacctcacctctttgttcttcctgtctcctttgaagtagactcattcttcacacgattgacctgtcctctttgtgataattctcagtagttgtccgtgataatcgtgtcctgaaaatcctcgcacacactggctggtggagaactcaaggctaattttttatcctttttttttttttaattttgagatatacgccctctttcatctgtaagggactaggaaattccaaatggtgtgaacccagggggcctttccctcttccctgacctcccaactctaaagccaagcactttatattttcctcttagatattcactaaggacttaaaataaaattttattgaaagaggaa

SEQ ID NO: 312279 - DNA, 2336 bp, Homo sapiens
gcagaggaggcggcggaacaccccgggttggtcgggtttccaagggctgacccgagctccagcactttttccgcgcctgatttttcagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312280 - DNA, 2312 bp, Homo sapiens
tgacaaaatcattcattaacaaggggagtttcggtgaagtggaggtttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312281 - DNA, 3454 bp, Homo sapiens
  misc_feature (1227)..(1227): n is a, c, g, or t
tacttaaattaacttgggtggttaataaagatgtaaatattcttcatccagtctataagaagagccaggaaccaaaaaaagatagcatatcttattttcatctctcagattcaccttatatttcaagagtctgagttgaatattatgttctcatttgtttctcattctagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggtcagtaatgcttaagtaaaattgcttaggaaggcatagatgaaaagagcacaaagggagctcattggggctgctgttgatgttgttgaaaatggaaggttgtttttctgcagtgtgtacgattcagccttcctgaagccaggattgggggtgaaggggaatgtaacagggcagagaataaatgctcaatctagctctacaccaagtcagaggatttttttttttttttttttgagtctgggtcttgctgtgcaaggctagagtgcagtggtgtggtcatagctcactgcagctgcagtcttgaactcctggactcaagcaatcctgccttggcatcccaaagtgctgggattacagacatgagccaccacacttagccagtcagaggtcttttttaatggaaattccagtttaaagaaatattctatatagacacatttgctagaattcacctggggtaatgaaggaatagttgatgacaaaaagaaatgttattcaatgttttctttagaaagggcagaccaaattattttaactgctggtattttttatatgatgtgacagaacataatcttccagggtgttagaatctggaacattaattatttgtgctatagctatatatttattactcttcaaaaggccacttcctaatccactgtttgactttgggcacatcatctactctagggtcccatttcctttctgaaaaataaggaaactgcattggaatctactagatcagtgcttctcaatactatctgacccaatgccccatttttagaacaaatgttaaaataaatctcatgnataatataacctacctagaaacagaatttcaataaataaaaatataagacattcaggaaaaactaaaatagaaggctcaataaagaggccagatttttacacccacttataatgaatcactttgcaattaaatgaagtaaggcagtagtcagctggatattgtggatactgttttacatttgacatgtacagtaagagctcaatacgtatatttgtatataacatggaatcactgtgaatgcacctgctacaaatgcagtccaatttagggtaatgggtgtcagctctaatatcatggctgctgatgtggttttccacatggccaaaaattcttagtcaagttctaaacatcataaagtaccatcttcctttaatttatgcaatagttgaatcttggaaatccaaacaaatgttgtaaatccgtagtaaaactgtctagactcacataattatatatatatttttttaaaatcatgaatgtccaggggaacatgagaaagttcaggacacagattaattctttgttgtgtatgacattcccaggattgcaagtcatctagcatcctgccccccaaccccaccgccaacacacacacacacaatcattttgctaatttttaaaaatgcccgctcagtttttcagaatgcctcctaaaaggtggtagatcctttgatgagaatcactacactagttgacccccaaagtccttctagttataaaatcatgagtttgtagaatcagtggcgttttaaactcccgttatattcagagcactgtgctagatgccacagtagattcagagaaggatatgatatggtctaggccctgatggaatcacattctgatatccttgaagagaaggctataggttcactggtgagtttaaggtttggggaagagaggtgcagtatccgactgagtgctcctgggagatttcctgggagcattgggtattgaaggaccaatagaactgaggtggtaaaaaggatttggagggttagagagaagtaaagagaactttactgagtgccctcaggtattgcacacctgctatatatgacacactgctattctctgacaaaccaaagatgagtaagacacatccatgcctaagaaaagtttagactaccagaagagatggaggtgcaaacagaaaagcaaatggtgacatgtaccaaatcagggtggcagtgagaaggcattaaataactggcacactctgtaatacactagtaagttcttaaattgctcacaaagcacaaattttcttccagaaacacatttcctaacaactccactaatagtgctgaaactcatgtcatccttactcacttcatgatggtttcctaaaaccgaacaatgacaacaacaaaaataacctatttcattttgaatctgaattctccagaaatttttttaattcaattttcactgtgcctacaattttgagactgttttgatttatagtcagagcaagagaaagaaattaaataatcgagtggcagattcccaacttgttattgctttcacatgaattactttcaaaatccaattactcaagttgccattttgatatcaatcatagactaaaagcttagcatatatattttttcatttacttataatttataccttctttataaaacaatgtcagtaactctgtcaagtatatgacattaaagcaaatgcaatatagaagtgcctcccttcccagtggacagctgccttgaaagttaagtacccaccaggggaatgggtacaagggggcttttggaaaccctcacatgaaactttctgtgaagaattatttcttgcacagtgatcccattctcccttctgttttttaagtatagcatgaaggcattgaggtgtgttggtattatttgttaatgttactgattcattacaaatgtctgtgcaataaatttttctgttaaagagtaaatgagccaggcttggtgactcacacttgtcatcccagcgctttgggaggctgaggcgggaggattgtttgagcccagcagtccaagaccagcctgggcaacatggcaaaaccccatctctacaaataatacaaaaattagctgggcctggtggtgcatgcctgtactcccagctacctgggaggctgaggtgggagaatcacctgagcccaggaggttgaggcttcagtgaactgtgatcgtgccactgcactccagcctggacagcagagtgagactcctc

SEQ ID NO: 312282 - DNA, 447 bp, Homo sapiens
tcgtgctgttccagaggacccccagcgcttaactacagcgctacctacagcgccttaggcttgcttgggttacaaggctgcaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggtaaagtgatttcttttgcacaaatgattcaacatattttgcacatacagaaaagtgccagagtgacagaactttccaaaagatgctgcttagtgaagagagatgcacatgaaattgcatttttttttctgtgacccacatagatggaaaggcagaggt

SEQ ID NO: 312283 - DNA, 2290 bp, Homo sapiens
cgtggggcggccgagccggagttgtgtcagtgaaggaatccagtccgggggccgagctggctgcgccctccgctgcaagcgccggcagcgcggggcgagctccggacggcgcgcggcccaggcagcggctcccgctcggcccgccctccgagccgcaggggccgccaccgccgcggcgcctcccctggcgaccgcgcccccgggccccggctccggcccgggacggaggagccggcgctcgacacagagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312284 - DNA, 2016 bp, Homo sapiens
gctctagaggactcgctttggatgcggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312285 - DNA, 2301 bp, Homo sapiens
cagaggacctcttatgctctgggattaacctccttccaatgattacatgctgtcagttacaatctacctattgcagataggaagcttcattgtaatagcaaatttctggttgaagagcttgctaaggtccaatcccagagcataagaggacttctgatttatttttgcttaaagggatacaatccaaggccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312286 - DNA, 2079 bp, Homo sapiens
gaagacttagggtatgaggaggtgaacgtcagtttttagagaaggtgttatgactgagtgtatgatgaagaagtaaatgatcatataaatgaattgatgcagtatcagtgaagaaatgtatgctagggacgaggtggtaaatgcttgatgtgtgatcactggacaacgtgactgcaaaaatgcaaaatgtgcccatgatgtggttgtggacaaggatcgaagctcgtccactacgattctgactaggcagagatgtacagccgcttatccctcgatggaggaaaggagatctcggtacttgaggaacctgcaaaaggcacttctgtgcggtctgcatgaatggcaaataaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312287 - DNA, 1393 bp, Homo sapiens
ctagccaggtcagcactaagactgagcgtggagcctcccagcaacagggctggaaagatccccaccaggtcagcactgcagtggacaccggaagagcagagtgaacgcatccacgggggtgccttggtcatttctgtaatcatggggttcctgcttttcatctctttcctccagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312288 - DNA, 2760 bp, Homo sapiens
tgacaaaatcattcattaacaaggggagtttcggtgaagtggaggtttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttgaaaaaaaaaaaaaaaaaaaaaaaaaaaaaaaaaaaaaaaaaaaaaaaaaaaaaaaaaaaaaaaaaaaaaaggggggggcgcgcgcgcacataagaagaattctcccgcaggggggggcgccaaatatatgacgcgagcgacccacccgttttttgttgaacaagagggggggcccacaaataaggaggagcggtaatattatataaagcgagcaggcgcacggggccgggacatatacaacc

SEQ ID NO: 312289 - DNA, 1024 bp, Homo sapiens
ctagagatagctgattctagaggataaccgtctgggatgtaatgtgtgatatccctgtgatacttatgagcatgctcgccgagaaaccggcgagcccctcatcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312290 - DNA, 1688 bp, Homo sapiens
tgacaaaatcattcattaacaaggggagtttcggtgaagtggaggtttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaattccacggtagaacacgtggggatcgtctaga

SEQ ID NO: 312291 - DNA, 1468 bp, Homo sapiens
tgacaaaatcattcattaacaaggggagtttcggtgaagtggaggtttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacactattcctcagactcctcgacctatagggatcctctagaacgcctcc

SEQ ID NO: 312292 - DNA, 1230 bp, Homo sapiens
tgacaaaatcattcattaacaaggggagtttcggtgaagtggaggtttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagacaatctcactcagtcctgt

SEQ ID NO: 312293 - DNA, 408 bp, Homo sapiens
  misc_feature (13)..(14): n is a, c, g, or t
cgcgctagaggannccaggaagccatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312294 - DNA, 467 bp, Homo sapiens
gcggccgcctactactactaaattcgcggccgcgtcgacctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggtaggtatacctgtaccctgcagctgaagatgttagacttaaatattccagatattccatattttttccttaaatgaactgaatatcaattcattatgtgtactttaggtctcatagaaatgtgcgaggtttcacatgattgcgctactgcactctagcctaggtgacagagtgagaccccatctcaaaa

SEQ ID NO: 312295 - DNA, 322 bp, Homo sapiens
gcggccgcctactactactaaattcgcggccgcgtcgacctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatgccagtgcaattccagttctaaaaaggtgatttctggcaggaaaaa

SEQ ID NO: 312296 - DNA, 352 bp, Homo sapiens
agctcttcagaaaccaggctgctttcaggaacattgctgtggattcccaggtgagtagagatggtccttccctctctgtgacctcctcctgctgccatggccagctgtccctacacctgcagctgcctcctgggagccttgtcacagcctttggccgcctctgctgcctctcagggctcaacaccagagttctcttttagagtgtgttgactgaagttattcctgatagggcagtggggtctggtggatgtaagtcagtgccaccccacccacatcccccttccccacctgccttgccacgtctgtggatctttagagtagtttcatgcatatgaaatactttgaagtacca

SEQ ID NO: 312297 - DNA, 415 bp, Homo sapiens
agcaccaagatgccctttcaaataacatctttcaaaagaaaactttttaatgtttttgtggagctcctggccagtttcttcatcttctagcgcttcctaatgggttactgaggcagcagtgttggaggtgcagctcgtaacactgagcactttattattgcagttacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcaggtaagccgacactggtgcagggtgccagagg

SEQ ID NO: 312298 - DNA, 2519 bp, Homo sapiens
tgacaaaatcattcattaacaaggggagtttcggtgaagtggaggtttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312299 - DNA, 739 bp, Homo sapiens
cgtggggcggccgagccggagttgtgtcagtgaaggaatccagtccgggggccgagctggctgcgccctccgctgcaagcgccggcagcgcggggcgagctccggacggcgcgcggcccaggcagcggctcccgctcggcccgccctccgagccgcaggggccgccaccgccgcggcgcctcccctggcgaccgcgcccccgggccccggctccggcccgggacggaggagccggcgctcgacacagagagctcttcagaaaccaggctgctttcaggaacattgctgtggattcccagctttcagacaacacatgactaagacagaatgagaccactctagttgcctcatgggaaactcgggaaaagactgcaaaaacaacattgtttctccctttggaattctggagttataaggcagaggtcccccatcttcccgaactgtaagtgaattccctctccattatcctcattcaatggccagccagcttctgcttgaacagattctgtgacaggagtctcactacctcccagggacagcttcacctgccctttaatgacaccaaatgtaacaggaataaagggaaaggaacataaggagatagtaagttaagggatgggtaaggaaaggaatgtgggcccgggaaagggtatttccctgggtggtttgttcctcactggggaagtggggagcaaaatttaacgcactgagaaaatgttgttcctcccattgataattt

SEQ ID NO: 312300 - DNA, 2497 bp, Homo sapiens
cgtggggcggccgagccggagttgtgtcagtgaaggaatccagtccgggggccgagctggctgcgccctccgctgcaagcgccggcagcgcggggcgagctccggacggcgcgcggcccaggcagcggctcccgctcggcccgccctccgagccgcaggggccgccaccgccgcggcgcctcccctggcgaccgcgcccccgggccccggctccggcccgggacggaggagccggcgctcgacacagagagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312301 - DNA, 2193 bp, Homo sapiens
ctgctcgaattcaagcttctaacgatgtacggggacatgtgaatgtcaaggaatagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312302 - DNA, 1783 bp, Homo sapiens
tgacagcctccttccaaagagtgcaggagacaagcgtaccccagatggcccagtcagagaccccactggtgaaatcataacagcctcaggtgccacacaagccacccacactgggttacaaacattctcctgatggaacttttactagacaaaagatgagtccctttttctggtgggctaattgctttgttttgttgtttagcttacaaacaaaggattaaatgctcaagttaataatattttttgacatcaattttaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312303 - DNA, 1346 bp, Homo sapiens
gtgtctcgacgacccttggccatgctgcactgctcgctggcttatccttgaagaactagcgatattcacagaacttgacgcggatatgggacagatgtacgtggtcgtggtcatagctgaaatcaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaaaagagtgtcaatcagaatatacaaatcccgtatggttgtgtcatcctctcttaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312304 - DNA, 2465 bp, Homo sapiens
tgacaaaatcattcattaacaaggggagtttcggtgaagtggaggtttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagaactccctgcagctccctgctgcctctgctgaatgcgcacgcagcaacctctgggaaacagagtaacttttcccgaaaatcatccactcacaataagccctctgaaggcaaagcggcaaaccccaaaatggtgagcagtctccccagcaccgccgacccctctcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312305 - DNA, 1454 bp, Homo sapiens
tgacaaaatcattcattaacaaggggagtttcggtgaagtggaggtttggggaaaggcgaggaagtcggtctggagcaagcaagcaaagtgcggaagctgtactgggattcttctagaaagtggggtgggaaaggagctagggagggcgtgtggagggacgagatctgtgtcagaacgtgcgtgtgagcggatacaaaacccgagagaggcgtgagcagcgctgtgtttgcgagcgggagcgaggggcgccggctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggcagtgcaattcaagttctaaaagaatggaatatgacaggaaaaaagaagaacaataaaagaaaaagaagcaagtccaagcagcatcaaggcaacaaagatgctaaagacaaggtggagaggcctgaggcagggcccctgcagccgcagccaccacagattcaaaacggccccatgaatggctgcgagaaggacagctcgtccacagattctgctaacgaaaaaccagcccttatccctcgtgagaaaaagatctcgatacttgaggaaccttcaaaggcacttcgtggggtcacagaaggcaacagactactgcaacagaaactatccttagatgggaaccccaaacctatacatggaacaacagagaggtcagatggcctacagtggtcagctgagcagccttgtaacccaagcaagcctaaggcaaaaacatctcctgttaagtccaatacccctgcagctcatcttgaaataaagccagatgagttggcaaagaaaagaggcccaaatattgagaaatcagtgaaggatttgcaacgctgcaccgtttctctaactagatatcgcgtcatgattaaggaagaagtggatagttccgtgaagaagatcaaagctgcctttgctgaattacacaactgcatcattgacaaagaagtttcattaatggcagaaatggataaagttaaagaagaagccatggaaatcctgactgctcgtcagaagaaagcagaagaactaaagagactcactgaccttgccagtcagatggcagagatgcagctggccgaactcagggcagaaattaagcactttgtcagcgagcgtaaatatgacgaggagctcgggaaagctgcccggttttcctgtgacatcgaacagctgaaggcccaaatcatgctctgcggagaaattacacatccaaagaacaactattcctcaagatcaagaatcgcaatcagcg

SEQ ID NO: 312306 - DNA, 970 bp, Homo sapiens
ctagagatagctgattctagaggataaccgtctgggatgtaatgtgtgatatccctgtgatacttatgagcatgctcgccgagaaaccggcgagcccctcatcaccagaccatgccggccaacaagcagaatggatcttctaaccaaagacggagatttaatccacagtatcataacaacaggctaaatgggcctgccaagtcgcagggcagtgggaatgaagccgagccactgggaaagggcaacagccgccacgaacacagaagacagccgcacaacggcttccggcccaaaaacaaaggcggtgccaaaaatcaagaggcttccttggggatgaagacccccgaggccccggcccattctgaaaagccccggcgaaggcagcacgctgcagacacctcggaggccaggcccttccggggtagtgtcggtagggtttcacagtgcaatctctgccccacgagaatagaagtttccacagatgcagcagttctctcagtcccggctgtgacgttggtggcctgagctaggaggaaaaagagcagttttcactcagttttggttccctgcccgaggtgctgacccaattcgctgccaatcatttttactaattctaataatcagctctagcttgcttcataattttcatggctttgcttgatctgttgatgctttctctcatcaagactttgcagcattttagccaggcagtatttactcattattaggaaaatcaagatgtggctgaagatcagaggctcagttagcaacctgtgttgtagcagtgatgtcagtccattgattgtctttagagagttaatgttacaaaaaagaattcttaataatcagacaaacatgatctgctgaggacacatgcgcttttgtagaatttaacatctggtgtttttctgaaaaaatatatatacatatattgctttatttgaaacaaattaaaatatgctgcatttga

SEQ ID NO: 312307 - DNA, 462 bp, Homo sapiens
gcggccgcctactactactaaattcgcggccgcgtcgacctggggtgtgtgctcctgagctcttcagaaaccaggctgctttcaggaacattgctgtggattcccagggcctattccactagaagcaagatggctgaactcaatactcatgtgaatgtcaaggaaaagatctatgcagttagatcagttgttcccaacaaaagcaataatgaaatagtcctggtgctccaacagtttgattttaatgtggataaagccgtgcaagcctttgtggatggtaggtatacctgtaccctgcagctgaagatgttagacttaaatattccagatattccatattttttccttaaatgaactgaatatcaattcattatgtgtactttaggtctcatagaaatgtgcgaggtttcacatgattgcgctactgcacgtcgacgcggccgcgaatttagtagtagtagg

SEQ ID NO: 312308 - DNA, 1514 bp, Homo sapiens
gggcaggacttccttgctggttgctaagacactcttgtttcgctccttgacaaccctggcgggggttcgctggctgcggccccggctccggcccccgcaggagcagcaccccccggggaaagacattttctgctcccaccgagttggcagggcctgcttcctgaatctcctgggtgtgtcttaactgccagtcccagcacctcctgaaagccccactctcctccagtggtcacagtggaaggatcatgggagaaacagaagggaagaaagatgaggctgattataagcgactgcagaccttccctctggtcaggcactcggacatgccagaggagatgcgcgtggagaccatggagctatgtgtcacagcctgtgagaaattctccaacaacaacgagagcgccgccaagatgatcaaagagacaatggacaagaagttcggctcctcctggcacgtggtgatcggcgagggctttgggtttgagatcacccacgaggtgaagaacctcctctacctgtacttcgggggcaccctggctgtgtgcgtctggaagtgctcctgacactctgtcccctgccccgtcccctgcagggccttttcctgccactcatctggggtggggagcagccctaggcaggtcctggtttttccaaggagagttggggtcttttctttttgtctttgtgtaccagtttcctgagccacgcccagtgtgtgaacttgacatctccatccccaggctctcaactgtctccctcggagtctcagggtgtggacggggcagcgggcatgggtctgtgtgggagacgtggggtggggcggtgtgacagggtagaggaggtgggagatgagatcttccgcacaggaacacgccagtccccctttctccagggctgccttccccttgcatcctgggagccccactgccctgccatccccagtactgccgggaagtgtcggccgtccttgtcattagtggtcatatgaaaatggccccaagaaggagatgattctttcaagggacacaggcagcttctctccttgtcctctggggaggtgctgacccctcagaaaccccttcccccaacttgaccccaggctgaacagaccactgcatctcactgggccagcagcccccccagcccccagccttggtggggaccaagcagcctttcccgtcccctcctcgacccgtacagttgagagccaggggctggtgtgtgggagctgctacctggcagtttctcgaggggtcaccgagcctctggtgggacacctgggcaggagtgctctcaccacgaggctgcttccgcagggaaccctggcctgcccgcgacttcgcatcagggaccgcatgctgatttgtactgctctctgctgggttttctatgttcttttcgagtgtgggaaaagggttttagtagaagggtgaatcgtattttacacagcggtcttatttatataaatgtcttggtttttacaattaaaatgaccaaaaactgaaaaaaaaaaa

SEQ ID NO: 312309 - DNA, 1222 bp, Homo sapiens
gggcaggacttccttgctggttgctaagacactcttgtttcgctccttgacaaccctggcgggggttcgctggctgcggccccggctccggcccccgcaggagcagagcgccgccaagatgatcaaagagacaatggacaagaagttcggctcctcctggcacgtggtgatcggcgagggctttgggtttgagatcacccacgaggtgaagaacctcctctacctgtacttcgggggcaccctggctgtgtgcgtctggaagtgctcctgacactctgtcccctgccccgtcccctgcagggccttttcctgccactcatctggggtggggagcagccctaggcaggtcctggtttttccaaggagagttggggtcttttctttttgtctttgtgtaccagtttcctgagccacgcccagtgtgtgaacttgacatctccatccccaggctctcaactgtctccctcggagtctcagggtgtggacggggcagcgggcatgggtctgtgtgggagacgtggggtggggcggtgtgacagggtagaggaggtgggagatgagatcttccgcacaggaacacgccagtccccctttctccagggctgccttccccttgcatcctgggagccccactgccctgccatccccagtactgccgggaagtgtcggccgtccttgtcattagtggtcatatgaaaatggccccaagaaggagatgattctttcaagggacacaggcagcttctctccttgtcctctggggaggtgctgacccctcagaaaccccttcccccaacttgaccccaggctgaacagaccactgcatctcactgggccagcagcccccccagcccccagccttggtggggaccaagcagcctttcccgtcccctcctcgacccgtacagttgagagccaggggctggtgtgtgggagctgctacctggcagtttctcgaggggtcaccgagcctctggtgggacacctgggcaggagtgctctcaccacgaggctgcttccgcagggaaccctggcctgcccgcgacttcgcatcagggaccgcatgctgatttgtactgctctctgctgggttttctatgttcttttcgagtgtgggaaaagggttttagtagaagggtgaatcgtattttacacagcggtcttatttatataaatgtcttggtttttacaattaaaatgaccaaaaactgaaaaaaaaaaa

SEQ ID NO: 312310 - DNA, 1092 bp, Homo sapiens
tctacctgtacttcgggggcaccctggctgtgtgcgtctggaagtgctcctgacactctgtcccctgcttcctgaatctcctgggtgtgtcttaactgccagtcccagcacctcctgaaagccccactctcctccagtggtcacagtggaaggatcatgggagaaacagaagggaagaaagatgaggctgattataagcgactcagccctaggcaggtcctggtttttccaaggagagttggggtcttttctttttgtctttgtgtaccagtttcctgagccacgcccagtgtgtgaacttgacatctccatccccaggctctcaactgtctccctcggagtctcagggtgtggacggggcagcgggcatgggtctgtgtgggagacgtggggtggggcggtgtgacagggtagaggaggtgggagatgagatcttccgcacaggaacacgccagtccccctttctccagggctgccttccccttgcatcctgggagccccactgccctgccatccccagtactgccgggaagtgtcggccgtccttgtcattagtggtcatatgaaaatggccccaagaaggagatgattctttcaagggacacaggcagcttctctccttgtcctctggggaggtgctgacccctcagaaaccccttcccccaacttgaccccaggctgaacagaccactgcatctcactgggccagcagcccccccagcccccagccttggtggggaccaagcagcctttcccgtcccctcctcgacccgtacagttgagagccaggggctggtgtgtgggagctgctacctggcagtttctcgaggggtcaccgagcctctggtgggacacctgggcaggagtgctctcaccacgaggctgcttccgcagggaaccctggcctgcccgcgacttcgcatcagggaccgcatgctgatttgtactgctctctgctgggttttctatgttcttttcgagtgtgggaaaagggttttagtagaagggtgaatcgtattttacacagcggtcttatttatataaatgtcttggtttttacaattaaaatgaccaaaaactgaaaaaaaaaaa

SEQ ID NO: 312311 - DNA, 1034 bp, Homo sapiens
gggcaggacttccttgctggttgctaagacactcttgtttcgctccttgacaaccctggcgggggttcgctggctgcggccccggctccggcccccgcaggagcagcaccccccggggaaagacattttctgctcccaccgagttggcagggcctgcttcctgaatctcctgggtgtgtcttaactgccagtcccagcacctcctgaaagccccactctcctccagtggtcacagtggaaggatcatgggagaaacagaagggaagaaagatgaggctgattataagcgactgcagaccttccctctggtcaggcactcggacatgccagaggagatgcgcgtggagaccatggagctatgtgtcacagcctgtgagaaattctccaacaacaacgagagcgccgccaagatgatcaaagagacaatggacaagaagttcggctcctccctgccatccccagtactgccgggaagtgtcggccgtccttgtcattagtggtcatatgaaaatggccccaagaaggagatgattctttcaagggacacaggcagcttctctccttgtcctctggggaggtgctgacccctcagaaaccccttcccccaacttgaccccaggctgaacagaccactgcatctcactgggccagcagcccccccagcccccagccttggtggggaccaagcagcctttcccgtcccctcctcgacccgtacagttgagagccaggggctggtgtgtgggagctgctacctggcagtttctcgaggggtcaccgagcctctggtgggacacctgggcaggagtgctctcaccacgaggctgcttccgcagggaaccctggcctgcccgcgacttcgcatcagggaccgcatgctgatttgtactgctctctgctgggttttctatgttcttttcgagtgtgggaaaagggttttagtagaagggtgaatcgtattttacacagcggtcttatttatataaatgtcttggtttttacaattaaaatgaccaaaaactgaaaaaaaaaaa

SEQ ID NO: 312312 - DNA, 1042 bp, Homo sapiens
gggcaggacttccttgctggttgctaagacactcttgtttcgctccttgacaaccctggcgggggttcgctggctgcggccccggctccggcccccgcaggagcaggtccccagaagtatgtgtagtggttagaaaaagctctttgtagtcagggcccttagtaaacttggctgaatcatggtgaccaagtcctggctgattaacgctggtagcagagagcactgtgataacagcgcagagagctttaacgtttcaaatcgctcacatacacatacctggggcttgcaacagcttcctgagaacgcagagataggatttagtatcccgtttcatagagaaggaaaccaaggcttaggtgaaattacttgctgacggctgcaaagaaaggaagtgagcagaatgctcgtctttgacagagctggtctccatgcctgcacactccggcttgcggcccacacagttcttagctctgcaagatgctgcacaggtcactctcccactggcttttccccgttgttcctgagaaatgggccttggtcatacctctgaagtcatgggacatctcagcaggattctgcatgttagagcagctgtcacagaccctgacctcctggagggtggcatgtccacaactggctcctggttccctcctggctcctacatgccagcactttttagcctccgggatgaattgaatcaaatggaaacatctcagtggaagatgcctaagaagctgcttccacatttttcattgttcccccttgaaattctcagagataaacaaactgtgtgcccttttccttctgtcatcagtgtagccgccacctctgtcacacctggacaaaggtagaggaggaagcagtaaggctaggaggacagcctggaattggaaatacgccttcacattcatgagcaaagacaaaatgattccctgaattttgtgaaataaggaacctgaccagaaagtacaatgaaattgtgcttggtaattcaccagcttgtagagagagacaaacaaaaactgctaacatctgagtggta

SEQ ID NO: 312313 - DNA, 430 bp, Homo sapiens
cttccaccactatgttttcctgagataagtcggggagtctgagagggagagaaggggggagactgagagtcagagagaggagagactaaggacgctaggtgggcagggctcttcacttgcaggtgcgcctgtgtgctgtgagttgctgggggttgtagaatgcttttggtggacagagggaaccaggttgcaatgtgagaacatttttatgaatttctgggaaactgccttaagatctattccaagagagacacctggttcttctcacctaacttgttgggtttccttttctcactctaaatattcactttaaggccgggcactgtggctcatgtctgtaatcctaatgctttgggaggctcaagcgatcctcggccttccaaagtgctgagattacaggcgttaagccactgagcctggctaaattaaa

SEQ ID NO: 312314 - DNA, 217 bp, Homo sapiens
ccttccctcaatcctgacgtccattggctgtctcttcgccggcggggcgtgggtacgggagccgggcgggcacgctccgaaccgcggcttaggtggcggcggcgaaggatgcacccggcaggcttggcggcggcggctgcggggacgccccggctgcagtggcgtacgtggccggcggaggagatcgggcgggcgggggcgtggcggggcggccgcg

SEQ ID NO: 312315 - DNA, 1196 bp, Homo sapiens
gagatcaaggatctggaaccctgaggtgtgcacagcgctgggatgccaggttcggcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtggccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggaaaaaaaagccactcct

SEQ ID NO: 312316 - DNA, 1207 bp, Homo sapiens
ctctgtaatcggacgagggggaagatcaccggcaggcttggggggcggctgggggacgccccggtgcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtggccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggaaaaaaaagccactcct

SEQ ID NO: 312317 - DNA, 1263 bp, Homo sapiens
cttccaccactatgttttcctgagataagtcggggagtctgagagggagagaaggggggagactgagagtcagagagaggagagactaaggacgctaggtgggcagggctcttcacttgcagcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtggccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggaaaaaaaagccactcct

SEQ ID NO: 312318 - DNA, 1375 bp, Homo sapiens
ccttccctcaatcctgacgtccattggctgtctcttcgccggcggggcgtgggtacgggagccgggcgggcacgctccgaaccgcggcttaggtggcggcggcgaaggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtggccatctttgtgttcatgtttccccttttgccgggcgcggtggctcatgcttgtaatcccagcactttgggaggccgaggcggtcggatcacgagatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggaaaaaaaagccactcct

SEQ ID NO: 312319 - DNA, 1373 bp, Homo sapiens
ccttccctcaatcctgacgtccattggctgtctcttcgccggcggggcgtgggtacgggagccgggcgggcacgctccgaaccgcggcttaggtggcggcggcgaaggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggtgagtacccccgcccttcacgccagccccagcccttgggccttgtcctcacacagcctcctctccctcccccaggatgattggcggggtcctcatgggcctgctcttcgggaagattggctactacctggtgctgggctggtgctgcgtggccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggaaaaaaaagccactcct

SEQ ID NO: 312320 - DNA, 1450 bp, Homo sapiens
ccttccctcaatcctgacgtccattggctgtctcttcgccggcggggcgtgggtacgggagccgggcgggcacgctccgaaccgcggcttaggtggcggcggcgaaggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggtgagtacccccgcccttcacgccagccccagcccttgggccttgtcctcacacagcctcctctccctcccccaggatgattggcggggtcctcatgggcctgctcttcgggaagattggctactacctggtgctgggctggtgctgcgtggccatctttgtgttcatgtttccccttttgccgggcgcggtggctcatgcttgtaatcccagcactttgggaggccgaggcggtcggatcacgagatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggaaaaaaaagccactcct

SEQ ID NO: 312321 - DNA, 1003 bp, Homo sapiens
ccttccctcaatcctgacgtccattggctgtctcttcgccggcggggcgtgggtacgggagccgggcgggcacgctccgaaccgcggcttaggtggcggcggcgaaggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtggccatctttgtgttcatgttccccttttgccgggcgcagctggttccgggccccacgcaccgggaccccctcagctgctgcgtctgccaagatcttcagtcgaccggttgtccacccagtagtagtaggcggc

SEQ ID NO: 312322 - DNA, 907 bp, Homo sapiens
gagatcaaggatctggaaccctgaggtgtgcacagcgctgggatgccaggttcgggtaggaggccccttggggggcgattctttaggaaattcctttagaagaaaacaacttgggactggatagcgtgcgatatgcagagaaatgcaactttcattcatttgcagttagcgatccgcccttccctgctccccacccttccgtggctccccagtacccgcctgctgtcgcccacacccttaggacagcttcgtggccccccgggagcgcagagggccatgcctaccgctcatttaagaagcgaacctgtattgtgctgttggcccccttttcctgtctcttcatctcccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccagatggagtgcgttcaactgaccggtgggcccccgttgacgtatgccgggcctctatcggatggttccgctagttgggggtgccgggaccgttgttccaccctggggtggggaccgccgttccgaggtgggcgaccatggtgacggcccagattggttgtaatggtgggcacccgacgctgggggcttccgcgtttgtttcgcctcattctttcctcg

SEQ ID NO: 312323 - DNA, 1298 bp, Homo sapiens
ccttccctcaatcctgacgtccattggctgtctcttcgccggcggggcgtgggtacgggagccgggcgggcacgctccgaaccgcggcttaggtggcggcggcgaaggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtggccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggaaaaaaaagccactcct

SEQ ID NO: 312324 - DNA, 1021 bp, Homo sapiens
ccttccctcaatcctgacgtccattggctgtctcttcgccggcggggcgtgggtacgggagccgggcgggcacgctccgaaccgcggcttaggtggcggcggcgaaggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtggccatctttgtgttcatgtttccccttttgccgggcgcggtggctcatgcttgtaatcccagcactttgggaggccgaggcggtcggatcacgaggtcaggagatcaagaccatcctggctaacacggtgaaaccccatctctactaaaaa

SEQ ID NO: 312325 - DNA, 1166 bp, Homo sapiens
gagatcaaggatctggaaccctgagcctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtggccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggaaaaaaaagccactcct

SEQ ID NO: 312326 - DNA, 1261 bp, Homo sapiens
ccttccctcaatcctgacgtccattggctgtctcttcgccggcggggcgtgggtacgggagccgggcgggcacgctccgaaccgcggcttaggtggcggcggcgaaggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcgggatgattggcggggtcctcatgggcctgctcttcgggaagattggctactacctggtgctgggctggtgctgcgtggccatctttgtgttcatgatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggcccgggccagtcccgtgggcagggacgctcaccatgtggagccggcaacaagggtaggaatccaggcagacgcaggggacgaaaaaaacacgggaaaacagctttggaaggtacgacagatagaacaaataacaaaaa

SEQ ID NO: 312327 - DNA, 1204 bp, Homo sapiens
ccttccctcaatcctgacgtccattggctgtctcttcgccggcggggcgtgggtacgggagccgggcgggcacgctccgaaccgcggcttaggtggcggcggcgaaggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctggccatcctgctcagcctctatctggtcactgtcaacaccgacctcaccaccatcgacctggtggccttcttgggctacaaatatgtcggatccggacgctgcggctgaagatcttggcagacgcagcagctgagggggtcccggtgcgtggggcccggaaccagctgcgcatgtacctgaccatggcggtggcggcggcgcagcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggaaaaaaaagccactcct

SEQ ID NO: 312328 - DNA, 1001 bp, Homo sapiens
ccttccctcaatcctgacgtccattggctgtctcttcgccggcggggcgtgggtacgggagccgggcgggcacgctccgaaccgcggcttaggtggcggcggcgaaggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagccttcctggctgacccggtgtccaacatggccatggcctatgggagcagcctggccgcgcagggcaaggagctggtggataagaacatcgaccgcttcatccccatcaccaagctcaagtattactttgctgtggacaccatgtatgtgggcagaaagctgggcctgctgttcttcccctacctacaccaggactgggaagtgcagtaccaacaggacaccccggtggccccccgctttgacgtcaatgccccggacctctacattccagcaatggctttcatcacctacgttttggtggctggtcttgcgctggggacccaggataggttctccccagacctcctggggctgcaagcgagctcagccctggcctggctgaccctggaggtgctgcctatgctcatgtactggctcaccttccacctggtgcggtgagcgcgcccgctgaacctcccgctgctgctgctgctgctgggggccactgtggccgccgaactcatctcctgcctgcaggccccaaggtccaccctgtctggccacaggcaccgcctccatcccatgtcccgcccagccccgcccccaacccaaggtgctgagagatctccagctgcacaggccaccgccccagggcgtggccgctgttacagaaacaataaaccctgatgggcatggaaaaaaaagccactcct

SEQ ID NO: 312329 - DNA, 738 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggca

SEQ ID NO: 312330 - DNA, 306 bp, Homo sapiens
agttaaagttagtgtcctataaatgtcatatataggtgaaggatactcagtgttgtggaatagctcaggaacaaaggtacatcagatgtggtctttggctaggtttctgtagctaccttttgattttgcagaaaaagccaccacgtgagaatggccataagcagataagtagcagttcaactggatgtctctcttctccaaatgctacagtacaaagccctaagcatgagtggaaaatcgttgcttcagaaaagacttcaagtaagtatatgacacttgccagattgttttcagcttacctatttt

SEQ ID NO: 312331 - DNA, 5207 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggtttattaacaaaactaggatacccaagactgaagaaacaagaagaaacctcaagtgtattgacacgtaaagaagcagcagtcctgccccagttctcctaagaaaaatccgctgtgggcagagaacgatgatgatttaatggtgtttactcctttacaggattcttgtctttaaagctgtgtgtttttcaatggtgttgttcatacatatagtcactcacttaacttgggctacttttaaaaaaaatacacaagataaaattgatggagaaatggtgggaattgaaaacacgcaggtggagcagtggagtaaccttgagtttctctctccacttaaacctttcggagttcctttatgagggcttaccaaatctgttaggcctgcagaaacactgtcatcattatggtctaaaagggctaacagattatctttaaattctatgattcccacttgaaagtcagatgcatttgccatgtatttgcatctgtctcaatggagatgactctacagcttgcttgaatttttgcatttgttttttctttgtttttcttgacattgcttacaggaaggaaatatgtttatgcaaaccagaccacttatctgcaaaggtgtaaactatattcagtattttattgtaaatatgtatattctttaagagtatatattgtactagtgctttttttcttactgttatatgatagaagctatgaaaaaaatgaagatttctttcaagccaatcaagccaacgactcttcagccagtattggaagattttgtatttgattttggttttttgtttttgttttttaatttttaccaccatgacatgtatttttctttacctccggatcctgccagagtaatatgtcaagaagctcaagaagcacactggaggttaccttgaggcgtttgtgtaatctgcatactagtggagtagccatggtgaccgtagccacatgggtgttctgttgctgttttgcaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaatccttgagatcacttctca

SEQ ID NO: 312332 - DNA, 3063 bp, Homo sapiens
ctgtaatcaggatatggaagagatgatgtctgagcaggaaaatccagattccagtgaagcagcagtcctgccccagttctcctaagaaaaatccgctgtgggcagagaacgatgatgatttaatggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaatccttgagatcacttctca

SEQ ID NO: 312333 - DNA, 3214 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttggtttattaaagaggttaatgctaacataaaaaaaaaaaggggggggcaaagttcccgagggcagttacctacccgtttgtcaagggccatggggggtaagaaggggggggttaaggcggggaagcgtgggtttgggccttgggggatggcaccaataaggggaaaaagggggagaggggagtggaaa

SEQ ID NO: 312334 - DNA, 2961 bp, Homo sapiens
agttaaagttagtgtcctataaatgtcatatataggtgaaggatactcagtgttgtggaatagctcaggaacaaaggtacatcagatgtggtctttggctaggtttctgtagctaccttttgattttgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaatccttgagatcacttctca

SEQ ID NO: 312335 - DNA, 2278 bp, Homo sapiens
acctgttccagcctaaaaatcccagaattgagaactaaccgcttgaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaatccttgagatcacttctca

SEQ ID NO: 312336 - DNA, 2824 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggca

SEQ ID NO: 312337 - DNA, 2753 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccttcatctttgcattcctttccaaataaacccaaaaagtatgtacagcatgtttaatagtatgcaatatgcaaaagctttgtgttgctgttagcaacatctatacccacccaccctctttattcacaagtgtacctctactaaccataattacatcactaagcctgttagtttgctcgtgcc

SEQ ID NO: 312338 - DNA, 2362 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatgaaaactgtttgtggaggtagcactctgtttgtggagtagcactggtaccgagctcga

SEQ ID NO: 312339 - DNA, 3253 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggtttattaacaaaactaggatacccaagactgaagaaacaagaagaaacctcaagtgtattgacacgtaaagaagcagcagtcctgccccagttctcctaagaaaaatccgctgtgggcagagaacgatgatgatttaatggtgtttactcctttacaggattcttgtctttaaagctgtgtgtttttcaatggtgttgttcatacatatagtcactcacttaacttgggctacttttaaaaaaaatacacaagataaaattgatggagaaatggtgggaattgaaaacacgcaggtggagcagtggagtaaccttgagtttctctctccacttaaacctttcggagttcctttatgagggcttaccaaatctgttaggcctgcagaaacactgtcatcattatggtctaaaagggctaacagattatctttaaattctatgattcccacttgaaagtcagatgcatttgccatgtatttgcatctgtctcaatggagatgactctacagcttgcttgaatttttgcatttgttttttctttgtttttcttgacattgcttacaggaaggaaatatgtttatgcaaaccagaccacttatctgcaaaggtgtaaactatattcagtattttattgtaaatatgtatattctttaagagtatatattgtactagtgctttttttcttactgttatatgatagaagctatgaaaaaaatgaagatttctttcaagccaatcaagccaacgactcttcagccagtattggaagattttgtatttgattttggttttttgtttttgttttttaatttttaccaccatgacatgtatttttctttacctccggatcctgccagagtaatatgtcaagaagctcaagaagcacactggaggttaccttgaggcgtttgtgtaatctgcatactagtggagtagccatggtgaccgtagccacatgggtgttctgttgctgttttgcaggttcaaaccttgtactactcagctgatcacaagctgcttgatgggaacctactagatggacaggctgaggtgtttggcagtgatgatgaccacattcagtttgtgcaggtacacattgcacagtctgaggtaacctcaggttaaaatttgactagagaatttgatagcatacttaaattttcctttaataaaggaaagtggaccaatttcattggtataactggacagaaacatttttgggagaaaacaagcatatcttagagttagtatttttgccacatgaaaagatattaacaaattaggaaaccctattgaaatttttttctcataaagcaggaattacaaacagtaaaggccaataagatggaacaatatagaaattatttgggaagattatgaaaagcagttgtttgtgtcaggcatgactgatagttttttttaaaaaggggcagggggacttaaattgttgatggctatgaaagaaatttttggatgttaccttaactactgagctgtcttactggaaattagaaatggtatagttaagatggactatacaatgtaataagtctaaaagtggtggatcatatgttaaaacctgatctagatgtttctttaaccaagatgaattaaaatatagtagagttccactgtgctgattgagttactttgccttttataaaatccaatttcatttttcccctatgagtaaacacataattattcagacacattatcaacaattactagagaacaaacttctcaagtataaattttttaagtttatggacaaatacagaaaagtacacaagtcataattaccacatagtgaacctaccagtgtaaacactacccaagtcaagaagaggtttctagcatcccggcagcctttctcttgcctcttcccaaccgtttccgtatagtgctcccaaaggaaaccattatcctaccttctgacacattaaattagtttggctatgcttg

SEQ ID NO: 312340 - DNA, 1094 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggca

SEQ ID NO: 312341 - DNA, 4225 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaatccttgagatcacttctca

SEQ ID NO: 312342 - DNA, 2892 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccc

SEQ ID NO: 312343 - DNA, 4366 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggtttattaacaaaactaggatacccaagactgaagaaacaagaagaaacctcaagtgtattgacacgtaaagaagcagcagtcctgccccagttctcctaagaaaaatccgctgtgggcagagaacgatgatgatttaatggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaatccttgagatcacttctca

SEQ ID NO: 312344 - DNA, 4189 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaatccttgagatcacttctca

SEQ ID NO: 312345 - DNA, 4172 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaatccttgagatcacttctca

SEQ ID NO: 312346 - DNA, 2763 bp, Homo sapiens
catcagtttacacaaaccaaaagtaataattacatcttaaacatggaactcttgtgcttacagataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcacatcatttcaagaagtcccctctcctccacatttgttttgccaatttgcacattaaatgactcttccctcaaatgtgtactatggggtaaaaggggtagggtttaaagatgtagacagttgggttttttaagggccctttttcaataactggaacactctataacaaaggatacttatttaaatagatgacattgactatttttgtttttattaaaaggaagcttacatgcctaccaatatttaatcttttatgattgcctttttataactttttatattctcagcagagtgctttaccaattgaagtaaaatgtggcaggctggagttattgaagcagagtggcagtcttcagtttgcagagtaggggtctgtcttttaaactctgagtgcaaacttcagagttcttgccttggctgcagtttttttccttcaagaatgcagtactaacatttatttgagtggagttactgaacagtaacatagctgtgatttttggtatttgaaacactggttttaaatattttgacttgttgagggtatgttttatatagcaagacattatatagcagtaaaaaatggtgttttatcttctatataattcctgtttttattattaacaaaacagtcctaaatagcagccctcaattgtgaaaaaatttactttaaactacattaggttgtgaatgcaggttttatcagaactatgtttttgttcagtttatctgttcatatggataaatattggttgggatgacttggtgtctaatgtgtagtgctacacacctaacttatggggccaaaatagcatgtcctaatgcttgctgctgatttaaacacattaaaggtactttgcaggaaatccttgcaccatgggattaatatccaattgctgcttgtacactcattcattactaaaagttttgagaaatttttttttccagtaatgagcttaagaaatttgtggaaaataactcacctggcatcttacatctgaaataaggaatgatataaggtttttttttctcacagaagatgaagcacacaggaacctaatgggccaactgggatgaggtgactattctgagatgactattcagtggctaacttgggttaggaagaaaataattaggtattttctccaaatgttcactggtactctgccactttatttctctcatctgttacacaaagaaccaccaggaaagcaaatcagtttggttggtaactctgtaattcctaactatcactggtttggttctggactaaaactacattgacagattgaatttgcctaatatgatgactgtttttaatatggatctgtatgtgttctattcagcacaaggaaataaaattttagttgaggattcagcactaaaatccttgagatcacttctca

SEQ ID NO: 312347 - DNA, 3202 bp, Homo sapiens
  misc_feature (3202)..(3202): n is a, c, g, or t
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtctataaccttgagtcaaatgaatggagcccctatacaaagattttccagttttaacaaatttaagaccctctcaaactaacaggcttagtgatgtaattatggttagcagaggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggcaacaaaaaaaacaaaaataaaaaaaaaaaaaaaatttttgggggcaatgggacctcagggaaaaagcttttatagaacacatctggtgttggaggcagagggggccccagattcaagacacggtcgaacaatgggccacacacacggggtgacccaaaaagagaaagactcccgaggcgcaagaaacaacgaggcgcgagggagattactccaacacaaaataaaaaacaccgccggggagaggacaacaagcggcgggatgcgtaacacaaccaacagaggagcggaaccagaagagcgaatgaaggggggctaaacagaccaggagcacgacaggagcagccacgaaataaaaattaccgcccgacactgtgggagn

SEQ ID NO: 312348 - DNA, 2584 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcaggtggctataacagagaggaatgtcttcgaacagtcgaatgctataatccacatacagatcactggtcctttcttgctcccatgagaacaccaagagcccgatttcaaatggctgtactcatgggccagctctatgtggtaggtggatcaaatggccactcagatgacctgagttgtggagagatgtatgattcaaacatagatgactggattcctgttccagaattgagaactaaccgttgtaatgcaggagtgtgtgctctgaatggaaagttatacatcgttggtggctctgatccatatggtcaaaaaggactgaaaaattgtgatgtatttgatcctgtaacaaagttgtggacaagctgtgcccctcttaacattcggagacaccagtctgcagtctgtgagcttggtggttatttgtacataatcggaggtgcagaatcttggaattgtctgaacacagtagaacgatacaatcctgaaaataatacctggactttaattgcacccatgaatgtggctaggcgaggagctggagtggctgttcttaatggaaaactgtttgtatgtggtggctttgatggttctcatgccatcagttgtgtggaaatgtatgatccaactagaaatgaatggaagatgatgggaaatatgacttcaccaaggagcaatgctgggattgcaactgtagggaacaccatttatgcagtgggaggattcgatggcaatgaatttctgaatacggtggaagtataacattttttagttgtatgtttggagtcactataccccgatttttaagatgttacaaattcgcttcctcactagtctt

SEQ ID NO: 312349 - DNA, 1959 bp, Homo sapiens
cgagacggaagcgggctgggaggcgtcggcggcggcagcgcacgtggtgacgtgcgagggggtgcggcgcgagcggtcggcggcggcggaggcagtgtctcccggtcgcgcgtggaggtcggtcgctcagagctgctgggcgcagtttctccgcctgctgcttcggcgcggctgtatcggcgagcgagcgagttcccgcgagttctcggtggcgctcccccttcctttcagtctccacggactggcccctcgtccttctacttgaccgctcccgtcttccgccgccttctggcgctttccgttgggccgattcccgcccgcttcctcctgcttcccatcgaagctctagaaatgaatgtttccatctcttcagagatgaaccagattatgatgcatcattatcacagaagaaattcgtgtctatagcttttaaggacttgattacatcattttcaagcctgatagttttggaatcaccattagagcttaagacacacctgccttcatttcaaccacctgtcttcataccctgacgaagtgcaccttttaacactcctttgtccttggattacttaagagttcccagaaatacatttgccaccaacagagtagccaaatttataaggaaaaatgattcccaatggatatttgatgtttgaggatgaaaattttattgagtcttctgttgccaaattaaatgccctgaggaaaagtggccagttctgtgatgttcgacttcaggtctgtggccatgaaatgttagcacacagagcagtgctagcttgctgcagtccctatttatttgaaatctttaatagtgatagtgatcctcatggaatttctcacgttaaatttgatgatctcaatccagaagctgttgaagtcttgttgaattatgcctacactgctcagttgaaagcagataaggaattggtaaaagatgtttattctgcagcaaaaaagctgaagatggatcgagtaaagcaggtttgtggtgattatttactgtctagaatggatgttaccagctgcatctcttaccgaaattttgcaagttgtatgggagactcccgtttgttgaataaggttgatgcttatattcaggagcatttgttacaaatttctgaagaggaggagtttcttaagcttccaaggctaaagttggaggtaatgcttgaagataatgtttgcttgcccagcaatggcaaattatatacaaaggtaatcaactgggtgcagcgtagcatctgggagaatggagacagtctggaagagctgatggaagaggttcaaaccttgtactactcagctgatcacaagctgcttgatgggaacctactagatggacaggctgaggtgtttggcagtgatgatgaccacattcagtttgtgcagaaaaagccaccacgtgagaatggccataagcagataagtagcagttcaactggatgtctctcttctccaaatgctacagtacaaagccctaagcatgagtggaaaatcgttgcttcagaaaagacttcaaataacacttacttgtgcctggctgtgctggatggtatattctgtgtcatttttcttcatgggagaaacagcccacagagctcaccaacaagtactccaaaactaagtaagagtttaagctttgagatgcaacaagatgagctaatcgaaaagcccatgtctcctatgcagtacgcacgatctggtctgggaacagcagagatgaatggcaaactcatagctgcagggtacacttgtgaataaagagggtgggtgggtatagatgttgctaacagcaacacaaagcttttgcatattgcatactattaaacatgctgtacatactttttgggtttatttggaaaggaatgcaaagatgaaggtctgttttgtgtacttttaagactttggttattttactttttggaaaagaataaaccaagaattgattgggca

SEQ ID NO: 312350 - DNA, 653 bp, Homo sapiens
gcacggaggaacaggggactcactgcttttctcccctttgggcccttgagcaggcatttgactgctgcatatgaacctgggagccatggggtcttaaggctttctacttgattctcagtgtggccagaattctgtttagggcactgctccaaatctcggtgacactccatctgtaaaattgggtggcagtgtagtgtgtgtgtgtgtgtgtgtgtattttcttatacaggactggaagagaatggcggaagaaggataatgacttaaaagcgaaaacaattgaattctttgagctacagtgctgtgtcctgagagtgcagttattttccactgcagtaatgctttcaaaaacatttatctagcttctctcactttctcatttgctgtcattggtgtgaaaaatcgagttaccagaaggttcacccatgttccacaggtatgaatactgaacgttttatttagtgtctcattaacagctggcctgtggctcctccttctcggcttgactctgccctgtccagggaaatggggaatcacgcttaaggattagcagggtgcctattttcacttacagtgcttcattcctgtgttcatgttacctattccctttacaaaatatgaatgagtatctttttgtgacaggctatattcta

SEQ ID NO: 312351 - DNA, 574 bp, Homo sapiens
ccagtggccagctcagttataggaaaggacacaagccacttgtgttcctggttcccttggtgtggtttgagagctacatttttctctaaaagcagaggttgcggtgagccgagatcgcgccattgcactccagcctgcgcaacaagagcgaaactccatcttaaaaaacaaacaaacaaacaaaaacaactagagcacatgctttgtaaaaatactcagaacagaattatatacagtaaaaagtaaaagattgaaccatgcaccctcagacaccccccacacaaataccctgttactccaatctacctccccagagtaaccagagcgatttggtgtgtagatcactgtgtgtcagatctgtttctataaatatgcaaccatatgtacataaatattagctaatattagctgggcatggtagtgctctgatagccctagctactcaggaggctgagcctagtagttagaggctgcagtgaactatgattgtgccaaggtactccagcccaggtgacagagcaagacctttgtctctaaaaatcaaatcaataaagaaaaagttttaaaaatgtgg

SEQ ID NO: 312352 - DNA, 4846 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312353 - DNA, 411 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgagaacgcgtgcgggggggcgtctgtgggaagggcgcggggcccgggcgagagtgggggaggggcttccgggaggggccgcgcgggaaggcggccgc

SEQ ID NO: 312354 - DNA, 541 bp, Homo sapiens
aaaggcttagaggatatacataatgttttctaaagttcaaaagggatatttttggctgtctttggagttaaaggtgggtcaagatgtcacaacatactctgataacctggaataagtcctggtttgggggactgagttttataattttttttatggggggggcagtttgcctgtgcattttatgaaaacgtttcctcattgaaatatttaataatatttgctaacgcatctggaaaaaaacttgttttaaaattttttagtttccagcattagaaattacatgctaaagctgtaccaaagttggtgtacaatttttctgaaagtgcttaaagataagattactggcttaacaaacaagctttgttccctgcattagtatcaagtctttgagaagcattttgtgttatgaatcagctggcagccttcccagagcaagtagtgggacaaaagttacactgttttatacccgacttctaacctgagtaaatgttcatctagcacacaaagttaaaaagttattcctatcttgaacaggggaaac

SEQ ID NO: 312355 - DNA, 301 bp, Homo sapiens
  misc_feature (1)..(1): n is a, c, g, or t
  misc_feature (71)..(71): n is a, c, g, or t
natttaaataaaggaaatacattttctacaaaatgcacgtaatacaaaaatgttggatttctaacgctggntcacaatggcacacaatcacaaaaattggctggtattccctaaaggtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312356 - DNA, 4720 bp, Homo sapiens
caactctcaggatcccccctacagcgccttgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312357 - DNA, 4792 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttatttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312358 - DNA, 5165 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttaattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctgaaaaaaaaaaacaaaaaaaaaaaaaacaacaaaaaacacaaaaaacaaaaaaagaagaaaaaacgacaaaaaaagatgtgggcggcgcgcgcaccggcgggccccaggagaaagtctctttgaaagacacacggcgggggagggcggcggggcccacagtagggcagagtaaacatcggggaccaaacgagggtgtccaccacgaagaaacaaccgggggggtgaacacaacagacaggggggggggggagtttctccacacaaaaaaaaaaaaaacgacgcggcggggagagaaaacaaagagcgcggcttttgaggaaaaaacaccgcaccaagaaggagggatcatcagcaagagggagacaacaaggggggggactaacatacagaggcgagagtcaaagagaagagacgcaagaaaaaaataaaatagccg

SEQ ID NO: 312359 - DNA, 5166 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaaggtgggagaagttgtgacacttttgaaaaaacggcttgcatgggttgggttcagggagttacctaggactctgcttccattgctttaatttgctatagcatttagagaaggtgcgtaatctctgaaagagtatccgattatcttgttgtaatgacaagatagctggtgtgaaagtcaactcctagttaatatttatacattaagtaaagatgttgtatcagagctatgctgttggagggtattttatgttaaagcagtcttgtgtgtaatgatagatatttcaatccagtttacaattatatatgtctatattttttgcagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312360 - DNA, 4733 bp, Homo sapiens
tccaagctgatctcgaactcctggcctcaagcagtcatcctgccccagcctcctagagtgctgggattacaggcatgagccactgcacctggcctgtcattcctgtttttgtgtatacggtccatgtggtcttaaaacctttcctgaacgtgtctcagttgaatttcccaagaaccttgtgggctgggtttagtggcggatattactaatattttacagataaggggaactactgaaatgcagaaaggtggcaagcatacagctcattattgtggtgccagaatcaaaatacaagtttcaaactccatcactgggaagttgagctttccagtgtctcatgctatgtttggctcagtgggtagacatccttgttcctaaccaatgctgtagaactatcacctgagaaatgatgcaagtttttactgccagccaagagacagtgttgccattccagttagtaggagaggaaatgccagttcttcagggcattttgacacaaataggacaagttgcacacataatgttatttaaacatccagaaagagttgtctttaaatatagccatgcttatttataaccctatgccttttccttctctcatcagaattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312361 - DNA, 3535 bp, Homo sapiens
caggaaacagcagagaaagaggcacagttttatttagaaatagttacattttggatagattccttgttacttgggcattcttttcattcattgaagctggatttttaaattttatattgctgctatttttaaaatacattttatttattttttttgcagatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtaagttttagaaagtatccaagtggattcaaacatcagggattttaagatttaaagaatgaatgacgagtggttcattgaatcctcaagaaacataaatgttgttttacaggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312362 - DNA, 3700 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312363 - DNA, 2215 bp, Homo sapiens
tgcctgtgattagaggatccggtcgacggggatcaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312364 - DNA, 4015 bp, Homo sapiens
  misc_feature (4002)..(4003): n is a, c, g, or t
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccgtcgacgcggccgcgaatttagtagtagtagnngtaggcggccgc

SEQ ID NO: 312365 - DNA, 4003 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatatgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312366 - DNA, 1679 bp, Homo sapiens
ctcagtttgcactgttttccctagctaaccatttgttggatgtaaacaagtaattctacgttgtacaagattgagatgacagtccagtgcaaatgagtttttataaagcttactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312367 - DNA, 3487 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattccttcctggttgccacagtatcttctcccatac

SEQ ID NO: 312368 - DNA, 3170 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgattagtctcttgctagccatggttctatcaaagctataaactattgatgatgcattattttcaagaaa

SEQ ID NO: 312369 - DNA, 2292 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgttccattaggcacattcaaaaaaaatcataaaatatccaagttaaacagtcgac

SEQ ID NO: 312370 - DNA, 1565 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtgggtatgattttttttttagaaaaaattttttataagccctgccatgtcacttagtttaacacatgcaaaataatatatttttaggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacggtaagtaacgcctcctttacc

SEQ ID NO: 312371 - DNA, 411 bp, Homo sapiens
gtgagtgaaagattataaccatagaaacagtaataatatcataaatttccccaactgattttaattttattctcatagctgttatttgttatggtttcacttttaagtttccagcaaacatttctgtaatggtatacttcacagatggaagattgcagagggaaggggaaagatagtttgccatctaatgaacacttaaattaattgcaataaagttattagatactttggagataggaatagggatgaagactagatgagatactcagctttcaacatttgttcaaccagttttcactggactgcctactgtgtgacaggcacttaaatgggcattgaatatataaaagagaaggaagggctgtttagttgaatgagactgaccatcttcagagcgaagctctcagggag

SEQ ID NO: 312372 - DNA, 361 bp, Homo sapiens
ggaaatgtgacagcatgagttcgttacatcagattaagtagatttttacgttttctttcagactgtctatgctgtgccaattctgatcttttcatttgtctgtcatcctgctgttcttcccatctatgaagaactgaaagagtgagtatttcatttttacataaatttgagaaaatattagacaattgctgtaactgctgctgaaatatatatttgaattttctcttgaattacatagccgcagccgtagaagaatgatgaatgtgtccaagatttcattttttgctatgtttctcatgtatctgcttgccgccctctttggatacctaacattttacggtaagtaacgcctcctttacca

SEQ ID NO: 312373 - DNA, 357 bp, Homo sapiens
gtaaatgttcatctagcacacaaagttaaaaagttattcctatcttgaacaggggaaactttttccaaacatgtcttttttgtgtgtttgttttcatggtattcctatgaaatgagtcctgttagaagatgtgtatatttttcagaggatatttgtgactgttttgaccttgtttctgttttctttagattgtggtatctgaacgggaactatttggttctgttggtgtcattggtggtcattcttcctttgtcgctgtttagaaatttaggtgagcaaactcatctctaaagagaattgaaatgagcctctcaccagttagttgggctttctctgaatagaaattaatcagaatga

SEQ ID NO: 312374 - DNA, 5281 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctgaaaaaaaaaaacaaaaaaaaaaaaaacaacaaaaaacacaaaaaacaaaaaaagaagaaaaaacgacaaaaaaagatgtgggcggcgcgcgcaccggcgggccccaggagaaagtctctttgaaagacacacggcgggggagggcggcggggcccacagtagggcagagtaaacatcggggaccaaacgagggtgtccaccacgaagaaacaaccgggggggtgaacacaacagacaggggggggggggagtttctccacacaaaaaaaaaaaaaacgacgcggcggggagagaaaacaaagagcgcggcttttgaggaaaaaacaccgcaccaagaaggagggatcatcagcaagagggagacaacaaggggggggactaacatacagaggcgagagtcaaagagaagagacgcaagaaaaaaataaaatagccg

SEQ ID NO: 312375 - DNA, 4730 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttaattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312376 - DNA, 4788 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312377 - DNA, 4958 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtaagttttagaaagtatccaagtggattcaaacatcagggattttaagatttaaagaatgaatgacgagtggttcattgaatcctcaagaaacataaatgttgttttacaggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312378 - DNA, 4789 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaacctcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatgaaatcttggtacaaattcagatctcttatttaaaatttaaataaggaatacattttcaaaatgcagtaatcaaaatgtgatctagtgtaatgaaataaaatgtgatctagtgtaatggaagacctttgagaacctgggtgtattaactttgtgtatatagtgtaaatatccccactgtactgttagaggccaacaattctagtatggcttgttggcaaagagtgctacaccgtttcaatgaaacaatgtatgtttgttttaactgaactaaaataaatacatgcttaatcctga

SEQ ID NO: 312379 - DNA, 4553 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacaactgtaatgttatttatagaacaacattaatccattaaagctaacctatttttcaatatttatgataatctatgtacatatattgtctgtccatatgtatttgtaaataggttgtatataatgtcaggtttgggtcttgggttcaagtgtatatattcctgtaagtttcttaactgcattttgatgaattcacattatgtaactataagaattgtcccaaaagtacctgtacagaaaattgaatattgaaaaattgacaaattgtgtacaaacactaaaaaaaacttgtttaaattgtatttgcaataaacaacatcaaattttttcatga

SEQ ID NO: 312380 - DNA, 4267 bp, Homo sapiens
  misc_feature (4254)..(4255): n is a, c, g, or t
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagactttttttttttttttgtatgggagaagatactgtggcaaccaggaaggaatggaaaaaaaattcttttctctacagcaaattaatgtgaggaagctcctccaatcctctggctatttaaggttcaaaatcaagtgcctagggaaaattccaatggatgattttctgggagctatcttgtctaccttgaggttcctgaacaatgaattcccattaatgagcagtcttcagtattaaaaccactgtcttgtcacctcattttgcattactgtcttccgtggatgtttcagttacagtcgacgcggccgcgaatttagtagtagtagnngtaggcggccgc

SEQ ID NO: 312381 - DNA, 4700 bp, Homo sapiens
  misc_feature (3949)..(3949): n is a, c, g, or t
  misc_feature (3951)..(3951): n is a, c, g, or t
  misc_feature (3966)..(3966): n is a, c, g, or t
  misc_feature (3975)..(3975): n is a, c, g, or t
  misc_feature (3977)..(3977): n is a, c, g, or t
  misc_feature (3985)..(3985): n is a, c, g, or t
  misc_feature (3988)..(3988): n is a, c, g, or t
  misc_feature (3996)..(3996): n is a, c, g, or t
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagacttttttttttttttggggtngngggaaaaagaatcgngtgggggcnanccgggaanagngatgtggnaaaaaaatttctttttcttcttacgagaaaatttaatgtggtgaggaaagcttcctctcaaatttcccttcgggcttattaagggttttcaaacctcaggtgggccttaggggaaatttccagtgggggagtgattttgcggggagctatctggtctacctgggggtccctggaacaaggattcccctttatggagcagtctccagtattaaacaccagggttttggttctccctcatttgggccataactggtctcccgggggatgttccaggtcacaccgtggtactggtttttttttagaacaccttattcccattaaggctacccctattcttccattttttctatggatactcctatgtccttatttggccgggaccattggctgcggccccgggtcgctatacaggggccggggggcccggggtccgggtatatatccctggaggttctaccgggttgtgggtggattccctttttgtcctattagattggccaatgtcgtgtcgaattcgttttggccttggccttgtggcacctctccaactgttctttgtttcggtacccctcatttctgacgtggactccgccctctttatatggccttccacgggccaggcgctgggaaatgcctgtgggccacccgcgttggtggtgcccgtggcatggggcccgcttgttggtttcccaccctcgtggtgg

SEQ ID NO: 312382 - DNA, 3746 bp, Homo sapiens
  misc_feature (3729)..(3729): n is a, c, g, or t
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatagtgcaattgggtaaaacagggtttattcagttgcatctgtctccagtgttgtattgacagctctgggtctttttttgggccagcccttttttgacattgcttccagcagtggaaaatgggcatttgatggcaataggccaaaattattgtgtccagagagtacactttttcaaaatgctcacctactggaagtgtgaattacttgacaatgtatggcttagttgtgttcatgttttgtctacagtagaggtctaatccacaggttacacctatgtttgatatgatataagttctctttgcgtaggccactgggtttctcatgcagtaagctttataaaaactcatttgcactggactgtcatctcattcttgtacaacgtagaattacttgtttacatccaacaaatggttagctagggaaaacagtgcaaactgagtgttagtagtcattttggtccaactgcatgtcaacccttccatttcaatcccagttagaaatgaaaataattactttgaaacttggctttaagagcacatttatcgtacgtcacagtgtatggtgaatatattattaaataatgtggtacttcgctcatcaggcataatgtctaaaatctaatatacataattccattaagtggttgaaggaagcaaataatggaattgtcaattggtcatctggctgtaaggtttgcccttgaactaaaaatgttgtttggggcaagggccagaaatgtggagacatggtttttgttacgcattcttgtattatatgtgactaaatttacaaacaagatacatgtgtaattaaagacccttatggaactggaagacgtcttgtagtgctacattgggtgaaaccgttggtccatttttgtctgtttctatgaagataaaaaaggcgccgctnggatccgtatgatcgac

SEQ ID NO: 312383 - DNA, 3857 bp, Homo sapiens
  misc_feature (3106)..(3106): n is a, c, g, or t
  misc_feature (3108)..(3108): n is a, c, g, or t
  misc_feature (3123)..(3123): n is a, c, g, or t
  misc_feature (3132)..(3132): n is a, c, g, or t
  misc_feature (3134)..(3134): n is a, c, g, or t
  misc_feature (3142)..(3142): n is a, c, g, or t
  misc_feature (3145)..(3145): n is a, c, g, or t
  misc_feature (3153)..(3153): n is a, c, g, or t
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgtttttttaagaaacttatctgtatgttagaaatggatatgaacaacaaaaccacgagtctcgggttaagggaagtgacaattttattccattccagagaatggacaaactcttaacttttatcaagccacatgcttggctgtgtcattgtttaacttggatattttatgattttacttgaatgtgcctaatggaaccatttgatgtgagaaacaattctttttaatttacagcaaaatattgaataaccattgacaaaaacactattattttttgtaccaaaaatacttaaagacctcagaagcactcttttacttttaagaaattgcttttttgaactttattcagaagcagttatcaataaattccataaaataatgtcattggtatttaaaaatgaatattaatataatgaaatggtttgcctttttgtaggcataataagccaaatacttttttacccaaaataatttttagagaaaatgatgtaatgaaaaattgtaccatgaattaggagcatagttttttccatttaaacgtcaccattacttaaaagatgattgattattgctataccaaatcagatgaactctgttcatcacttttcttctctgtccccaaacaatttggttcattcagactgaaatgtttgtgtcttcaacttattagaatggaagataatgcagatatttctgtgggaaataaaataactaattttgaggtaccaaatatgctacattgggtgaaaccgttggtccatttttgtctgtttctatgaagataaaataattgggggccatctagaaatagaaaggcagtgggaagacagattctacggcactgctttcatttaattgggctttaggcactccattcgaatgcagaacctcacctctagttgagaccaagaattggcaaatttgcatgagctcctggaaagagttgctgactttgtatctaagacctgccagggaataccaagagttgtttctacagacttttttttttttttggggtngngggaaaaagaatcgngtgggggcnanccgggaanagngatgtggnaaaaaaatttctttttcttcttacgagaaaatttaatgtggtgaggaaagcttcctctcaaatttcccttcgggcttattaagggttttcaaacctcaggtgggccttaggggaaatttccagtgggggagtgattttgcggggagctatctggtctacctgggggtccctggaacaaggattcccctttatggagcagtctccagtattaaacaccagggttttggttctccctcatttgggccataactggtctcccgggggatgttccaggtcacaccgtggtactggtttttttttagaacaccttattcccattaaggctacccctattcttccattttttctatggatactcctatgtccttatttggccgggaccattggctgcggccccgggtcgctatacaggggccggggggcccggggtccgggtatatatccctggaggttctaccgggttgtgggtggattccctttttgtcctattagattggccaatgtcgtgtcgaattcgttttggccttggccttgtggcacctctccaactgttctttgtttcggtacccctcatttctgacgtggactccgccctctttatatggccttccacgggccaggcgctgggaaatgcctgtgggccacccgcgttggtggtgcccgtggcatggggcccgcttgttggtttcccaccctcgtggtgg

SEQ ID NO: 312384 - DNA, 2304 bp, Homo sapiens
actgacgcgtccccggggtgccgctataacccgccgctcgcagggctgctccacagccgcgcgacgccgccgccttagaacgcctttccagtactgctagcagcagcccgaccacgcgttaccgcacgctcgcgcctttcccttgacacggcggacgccggaggattggggcggcaatttgtcttttccttttttattaaaattatttttcctgcctgttgttggatttggggaaattttttgtttgttttttatgatttgtatttgactgagagaaacccactgaagacgtctgcgtgagaatagagaccaccgaggccgactcgcgggccgctgcacccaccgccaaggacaaaaggagcccagcgctactagctgcacccgattcctcccagtgcttagcatgaagaaggccgaaatgggacgattcagtatttccccggatgaagacagcagcagctacagttccaacagcgacttcaactactcctaccccaccaagcaagctgctctgaaaagccattatgcagatgtagatcctgaaaaccagaactttttacttgaatcgaatttggggaagaagaagtatgaaacagaatttcatccaggtactacttcctttggaatgtcagtatttaatctgagcaatgcgattgtgggcagtggaatccttgggctttcttatgccatggctaatactggaattgctctttttataattctcttgacatttgtgtcaatattttccctgtattctgttcatctccttttgaagactgccaatgaaggagggtctttattatatgaacaattgggatataaggcatttggattagttggaaagcttgcagcatctggatcaattacaatgcagaacattggagctatgtcaagctacctcttcatagtgaaatatgagttgcctttggtgatccaggcattaacgaacattgaagataaaactggattgtggtatctgaacgggaactatttggttctgttggtgtcattggtggtcattcttcctttgtcgctgtttagaaatttaggatatttgggatataccagtggcctttccttgttgtgtatggtgttctttctgattgtggtcatttgcaagaaatttcaggttccgtgtcctgtggaagctgctttgataattaacgaaacaataaacaccaccttaacacagccaacagctcttgtacctgctttgtcacataacgtgactgaaaatgactcttgcagacctcactattttattttcaactcacagactgtctatgctgtgccaattctgatcttttcatttgtctgtcatcctgctgttcttcccatctatgaagaactgaaagaccgcagccgtagaagaatgatgaatgtgtccaagatttcattttttgctatgtttctcatgtatctgcttgccgccctctttggatacctaacattttacgaacatgttgagtcagaattgcttcatacctactcttctatcttgggaactgatattcttcttctcattgtccgtctggctgtgttaatggctgtgaccctgacagtaccagtagttattttcccaatccggagttctgtaactcacttgttgtgtgcatcaaaagatttcagttggtggcgtcatagtctcattacagtgtctatcttggcatttaccaatttacttgtcatctttgtcccaactattagggatatctttggttttattggtaagttttagaaagtatccaagtggattcaaacatcagggattttaagatttaaagaatgaatgacgagtggttcattgaatcctcaagaaacataaatgttgttttacaggtgcatctgcagcttctatgttgatttttattcttccttctgccttctatatcaagttggtgaagaaagaacctatgaaatctgtacaaaagattggggctttgttcttcctgttaagtggtgtactggtgatgaccggaagcatggccttgattgttttggattgggtacacaatgcacctggaggtggccattaattggcaccactcaaactcaaactcagtccatctgatgccagtgttgagtaaactcaactactatgaaatttcacctaatgttttcagtttcacttccttttgaagtgcagattcctcgctggttcttctgagtgcagaataagtgaacttttttgttttgttttgttttttagagacagagtctggctttgtcacccaggctggagtgctgtggtgcgatcacgaatcactgcagcctcgacttcctgacctcaaacattccttccac

SEQ ID NO: 312385 - DNA, 423 bp, Homo sapiens
tctcagatatccggaatggcatcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggtaagtaagactaaagataaggaagtaaaatatttatcctactct

SEQ ID NO: 312386 - DNA, 7576 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggttcgtagctatccacaccaacataatggctctcctcccacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttatgcttaccaaatgtgccttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggtggaggagggtgtcacttcagatggggcaggcacagggggagaaaagaagagaaaaacacacctgtgtgcaaaatgagctatttggtttcagtgcggcctgaccgatggggaggacccatgagcagagagagttctaggtcaacattgtaactccattgtcctccttcacccataagtcagtcctccttcctcattacagtgaaaccaacaatatgcagaggttggggagagatgcctgttcttcccccagcttcatataattgtcaaagttccaaaaatgaattatctgaactgcttaaaactggaaattaaaatctagacaagaatatgtctttcaagagctttttatgttttgaaagttcataaacctaagattggctccatctgagataaattttcttttctttttttttttgagacggagtctcgttctgtctcccaggctggagtgcagtggcatgatctcggctcactgcaacctccacctcctaggttcaagtgattctcctgagtagctggggttatagctacccaccaccacacccagctaatttttgtatttttagtagaggcaggttttcaccatgttggctaggctggtcttgaactcccgacctcaagtgatccacctgccttggcctcccaaagtgctgggattataggtgtgagcccccgtgcctggcccacaataaattttcatttcagagaaggaaaaaaatctcttgaacgtccagaaatgatttctggaatcagaatttcaatatgtaataccctcaggtaggcaatcttgaaccctctatgcagtgagagcattattaatatgagatgttgaatgatgcctttacagacttcagcagcaaagccatttggttgaggttttctgtgttaatgtgaaaagctaagccactgagatttgcaggggagcttctgagccaccctgcttgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttcccagctactcgggaggctgaggtgggagaatcccttgaacccaggaggcagaagttgcagtgagctgagatcatgccattgcactccagcctgggcaacagagcgagacttcatctccaaaaaaagaaaaagaagaaaaagatttataatttctgagtcccctaagtccctttctcagtttgcaataatcttacgtccatgctattgacactaattttgaaactggaaagctaattaatgacatattcatgtgttctttcatctaataaacatttattaatgtatagttctacaccaggcattctgaagggtccaaaagaaagttcctgccctctagtagcacataatccgttatttctcagcacaccatgccatctgtttatcattcagcagttaagtaattcatcacttcatatttttaccaaagtatatttacaagtctgtttatctggatctggcaaactggaaaatgtttgaagggatactcaggctttgatccatgccaacatgaaaggactccaagcacatttaagtaggctggtcttttcatcatgcatgattttttttttagtgcaaatttagactttagtttgggaaagagaacagtatacagtatcctttgtaagataaatcacaacaacaaaaattaagttttattgcacaaagtagataaatgagaaagtctttcttaaaaaatgcttctttaactgtaacagcaaaactaaatgcatattttatcaaccccttatttctaattgctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcactttagcccaggaggtccagaccagcctgggcaacacagcgggaccccgactccatttaaaaaattaaaaaaaaaaaaaaaacttttaacatttaaaaaataaaaattaacaaaatttcacttattccaggacacgctggcatttggactcaatgaaaagggcacctaaagaaaataaggctgactgaatgttttccataattttcacacaataacagtccctttctatccagcttgccttccatttatctctagggttagcttttcaggcaacatccttggtcattgcccagaaagtacctgagctatcagtgattggaatggcacaggaaaccgaatcacatgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtcacgtgggttgttt

SEQ ID NO: 312387 - DNA, 6760 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggttcgtagctatccacaccaacataatggctctcctcccacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttatgcttaccaaatgtgccttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggtggaggagggtgtcacttcagatggggcaggcacagggggagaaaagaagagaaaaacacacctgtgtgcaaaatgagctatttggtttcagtgcggcctgaccgatggggaggacccatgagcagagagagttctaggtcaacattgtaactccattgtcctccttcacccataagtcagtcctccttcctcattacagtgaaaccaacaatatgcagaggttggggagagatgcctgttcttcccccagcttcatataattgtcaaagttccaaaaatgaattatctgaactgcttaaaactggaaattaaaatctagacaagaatatgtctttcaagagctttttatgttttgaaagttcataaacctaagattggctccatctgagataaattttcttttctttttttttttgagacggagtctcgttctgtctcccaggctggagtgcagtggcatgatctcggctcactgcaacctccacctcctaggttcaagtgattctcctgagtagctggggttatagctacccaccaccacacccagctaatttttgtatttttagtagaggcaggttttcaccatgttggctaggctggtcttgaactcccgacctcaagtgatccacctgccttggcctcccaaagtgctgggattataggtgtgagcccccgtgcctggcccacaataaattttcatttcagagaaggaaaaaaatctcttgaacgtccagaaatgatttctggaatcagaatttcaatatgtaataccctcaggtaggcaatcttgaaccctctatgcagtgagagcattattaatatgagatgttgaatgatgcctttacagacttcagcagcaaagccatttggttgaggttttctgtgttaatgtgaaaagctaagccactgagatttgcaggggagcttctgagccaccctgcttgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttccagctgaatgaatgcacttagctgataaaccagaatttgttcttttttttccttctttttttttggagacaggttctcactctgtcaccgaggttggagtgcagtggtatgatcatagctgactgcagcctcaaccttctgggctcaaatgatcctttcacctcagcctcctgagtagctgggaccacaggtgtgtgccaccacacctggctaatttttatggatttttttttcttttttttttttcgccatgttgcccaggctggtcttgaactcttggcactcaagcagtccttctgcctcagcctcccaaagtgctgggattacagatgtgagccactgcacctggccccagaaattatgcttaaaaaaaaaattaagctgtgtggaatctggacaaggctatgtttctcctagaaacaggttttgctgtaaatggttttgatgggcgaaagtgtgagaaaaggttataatagattcttttttttaattttgtgagaaattccaggtcttcttgcttaacttatatgcatgtggatatatttgttttcaaagccatggaagaatctctgttcatatattttaatgcaaattaccttgtatgctgctatgcaaattctattaaaaggcctacctgcttaagaattaaacatttttgaaactttcagggaagacctgtagactcaagcactttctctgcttttttgtatcttatcttggacacttatgctgaattatgttcttattattttcactggttataagctattccttgtacataatatttaaactatccaaatatccagcatacatttccatgtggctgccatcggctgttgatgccatgaatgaaatggctggttagaaagccaaaggtcttcttttttcaattcctaatgaataagtaaaatgccagatctctttggtctcaaagcaaattgctctgatcagatcaaatatctatgtaatgaaaagagacttacttaaatttgggattctgcttaaactttaagttgaatttgactgtagtcattcattctttttatatatctctgtcaggtatgacattaattaccaggtggtattatactctactttgagtttggacatcactttcagttaaatttctgttgttattgtggcttttttttttttttaaccccactgaagatggaagtagagcagtctgccatctcctgctgttctttctctgtgccccctaattgcttggtaatctaaaattattctgactttccacatactgtctttaaaaaccaattgtagcaatctgcccgcctccaccctttaagctaaatctttcactgtgctggtcttgaactcttggcactcaagcagtccttctgcctcagcctcccaaagtgctgggattacagatgtgagccactgcacctggccccagaaattatgc

SEQ ID NO: 312388 - DNA, 3421 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggttcgtagctatccacaccaacataatggctctcctcccacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttatgcttaccaaatgtgccttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggtggaggagggtgtcacttcagatggggcaggcacagggggagaaaagaagagaaaaacacacctgtgtgcaaaatgagctatttggtttcagtgcggcctgaccgatggggaggacccatgagcagagagagttctaggtcaacattgtaactccattgtcctccttcacccataagtcagtcctccttctgcatattgttggtttcactgtaatgagggtcgac

SEQ ID NO: 312389 - DNA, 9659 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttatgcttaccaaatgtgccttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggtggaggagggtgtcacttcagatggggcaggcacagggggagaaaagaagagaaaaacacacctgtgtgcaaaatgagctatttggtttcagtgcggcctgaccgatggggaggacccatgagcagagagagttctaggtcaacattgtaactccattgtcctccttcacccataagtcagtcctccttcctcattacagtgaaaccaacaatatgcagaggttggggagagatgcctgttcttcccccagcttcatataattgtcaaagttccaaaaatgaattatctgaactgcttaaaactggaaattaaaatctagacaagaatatgtctttcaagagctttttatgttttgaaagttcataaacctaagattggctccatctgagataaattttcttttctttttttttttgagacggagtctcgttctgtctcccaggctggagtgcagtggcatgatctcggctcactgcaacctccacctcctaggttcaagtgattctcctgagtagctggggttatagctacccaccaccacacccagctaatttttgtatttttagtagaggcaggttttcaccatgttggctaggctggtcttgaactcccgacctcaagtgatccacctgccttggcctcccaaagtgctgggattataggtgtgagcccccgtgcctggcccacaataaattttcatttcagagaaggaaaaaaatctcttgaacgtccagaaatgatttctggaatcagaatttcaatatgtaataccctcaggtaggcaatcttgaaccctctatgcagtgagagcattattaatatgagatgttgaatgatgcctttacagacttcagcagcaaagccatttggttgaggttttctgtgttaatgtgaaaagctaagccactgagatttgcaggggagcttctgagccaccctgcttgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttccagctgaatgaatgcacttagctgataaaccagaatttgttcttttttttccttctttttttttggagacaggttctcactctgtcaccgaggttggagtgcagtggtatgatcatagctgactgcagcctcaaccttctgggctcaaatgatcctttcacctcagcctcctgagtagctgggaccacaggtgtgtgccaccacacctggctaatttttatggatttttttttcttttttttttttcgccatgttgcccaggctggtcttgaactcttggcactcaagcagtccttctgcctcagcctcccaaagtgctgggattacagatgtgagccactgcacctggccccagaaattatgcttaaaaaaaaaattaagctgtgtggaatctggacaaggctatgtttctcctagaaacaggttttgctgtaaatggttttgatgggcgaaagtgtgagaaaaggttataatagattcttttttttaattttgtgagaaattccaggtcttcttgcttaacttatatgcatgtggatatatttgttttcaaagccatggaagaatctctgttcatatattttaatgcaaattaccttgtatgctgctatgcaaattctattaaaaggcctacctgcttaagaattaaacatttttgaaactttcagggaagacctgtagactcaagcactttctctgcttttttgtatcttatcttggacacttatgctgaattatgttcttattattttcactggttataagctattccttgtacataatatttaaactatccaaatatccagcatacatttccatgtggctgccatcggctgttgatgccatgaatgaaatggctggttagaaagccaaaggtcttcttttttcaattcctaatgaataagtaaaatgccagatctctttggtctcaaagcaaattgctctgatcagatcaaatatctatgtaatgaaaagagacttacttaaatttgggattctgcttaaactttaagttgaatttgactgtagtcattcattctttttatatatctctgtcaggtatgacattaattaccaggtggtattatactctactttgagtttggacatcactttcagttaaatttctgttgttattgtggcttttttttttttttaaccccactgaagatggaagtagagcagtctgccatctcctgctgttctttctctgtgccccctaattgcttggtaatctaaaattattctgactttccacatactgtctttaaaaaccaattgtagcaatctgcccgcctccaccctttaagctaaatctttcactgtgctggatacatagacactcgataaatgtgtgatgatagttctaaaataattatgctatatatcagggttctgtatttttgagcaatatcattattcctatgctgtgatgttaaatggaatttattttacactagtaatagactgcttaagtggctgatttgaaacctttctctaaaaaaacaaaaacatctggcagatgagtgacacaaattcattctcttaaaggatagaatttcaagttaaggataaggcacaataaataggcacatagaggacatctgtttttgtttttggtttgggttttgtttttttttggtctctctgactagctaaactgccaactagaagaatggttgttatgtagtaactcagaagaatcttttaataagtttcttctttggtttcaaaacaaacttgagcttcatttcttgccacctctattctttcttcccacgttgggtgactgaactgatgcttattctagttttagaagaggatccacatttaatgtaaggcataaatatgccttttgcaaattattgcttgttctccagtgaacatttgatcatattcaacagaaatccaccatataaaccataatccttgaattgccccttttaaaatagattggttaaaaccaaaaacctataagagagaaatgatatttcattgtattgtaggtttgggaatcctggttagatttataatttctggccgggtgcggtggctcatgcctgtattcccagtactttgggagcccaaggtgggtggatcacctgaggtaaggagtttgagaccagcctggccaacatggtgaaaccccatctctactaaaaatacaaaaagttagctgggcatggtggtgcgcgcctgtggtcccagctactcgggaggctgaggtgggagaatcccttgaacccaggaggcagaagttgcagtgagctgagatcatgccattgcactccagcctgggcaacagagcgagacttcatctccaaaaaaagaaaaagaagaaaaagatttataatttctgagtcccctaagtccctttctcagtttgcaataatcttacgtccatgctattgacactaattttgaaactggaaagctaattaatgacatattcatgtgttctttcatctaataaacatttattaatgtatagttctacaccaggcattctgaagggtccaaaagaaagttcctgccctctagtagcacataatccgttatttctcagcacaccatgccatctgtttatcattcagcagttaagtaattcatcacttcatatttttaccaaagtatatttacaagtctgtttatctggatctggcaaactggaaaatgtttgaagggatactcaggctttgatccatgccaacatgaaaggactccaagcacatttaagtaggctggtcttttcatcatgcatgattttttttttagtgcaaatttagactttagtttgggaaagagaacagtatacagtatcctttgtaagataaatcacaacaacaaaaattaagttttattgcacaaagtagataaatgagaaagtctttcttaaaaaatgcttctttaactgtaacagcaaaactaaatgcatattttatcaaccccttatttctaattgctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcactttagcccaggaggtccagaccagcctgggcaacacagcgggaccccgactccatttaaaaaattaaaaaaaaaaaaaaaacttttaacatttaaaaaataaaaattaacaaaatttcacttattccaggacacgctggcatttggactcaatgaaaagggcacctaaagaaaataaggctgactgaatgttttccataattttcacacaataacagtccctttctatccagcttgccttccatttatctctagggttagcttttcaggcaacatccttggtcattgcccagaaagtacctgagctatcagtgattggaatggcacaggaaaccgaatcacatgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtcacgtgggttgttt

SEQ ID NO: 312390 - DNA, 9946 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggacggagtttcgctgtgtctcccaggctggagtgcaacggcgcaatctcggctgacgataacctctgcctcccaggttcaagcctataatgaggaaatttctgtctgaccaatatcaggggcacatcagctgctgtactaagtttcttcaaatatcctggaattgtgtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggttcgtagctatccacaccaacataatggctctcctcccacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttatgcttaccaaatgtgccttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggtggaggagggtgtcacttcagatggggcaggcacagggggagaaaagaagagaaaaacacacctgtgtgcaaaatgagctatttggtttcagtgcggcctgaccgatggggaggacccatgagcagagagagttctaggtcaacattgtaactccattgtcctccttcacccataagtcagtcctccttcctcattacagtgaaaccaacaatatgcagaggttggggagagatgcctgttcttcccccagcttcatataattgtcaaagttccaaaaatgaattatctgaactgcttaaaactggaaattaaaatctagacaagaatatgtctttcaagagctttttatgttttgaaagttcataaacctaagattggctccatctgagataaattttcttttctttttttttttgagacggagtctcgttctgtctcccaggctggagtgcagtggcatgatctcggctcactgcaacctccacctcctaggttcaagtgattctcctgagtagctggggttatagctacccaccaccacacccagctaatttttgtatttttagtagaggcaggttttcaccatgttggctaggctggtcttgaactcccgacctcaagtgatccacctgccttggcctcccaaagtgctgggattataggtgtgagcccccgtgcctggcccacaataaattttcatttcagagaaggaaaaaaatctcttgaacgtccagaaatgatttctggaatcagaatttcaatatgtaataccctcaggtaggcaatcttgaaccctctatgcagtgagagcattattaatatgagatgttgaatgatgcctttacagacttcagcagcaaagccatttggttgaggttttctgtgttaatgtgaaaagctaagccactgagatttgcaggggagcttctgagccaccctgcttgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttccagctgaatgaatgcacttagctgataaaccagaatttgttcttttttttccttctttttttttggagacaggttctcactctgtcaccgaggttggagtgcagtggtatgatcatagctgactgcagcctcaaccttctgggctcaaatgatcctttcacctcagcctcctgagtagctgggaccacaggtgtgtgccaccacacctggctaatttttatggatttttttttcttttttttttttcgccatgttgcccaggctggtcttgaactcttggcactcaagcagtccttctgcctcagcctcccaaagtgctgggattacagatgtgagccactgcacctggccccagaaattatgcttaaaaaaaaaattaagctgtgtggaatctggacaaggctatgtttctcctagaaacaggttttgctgtaaatggttttgatgggcgaaagtgtgagaaaaggttataatagattcttttttttaattttgtgagaaattccaggtcttcttgcttaacttatatgcatgtggatatatttgttttcaaagccatggaagaatctctgttcatatattttaatgcaaattaccttgtatgctgctatgcaaattctattaaaaggcctacctgcttaagaattaaacatttttgaaactttcagggaagacctgtagactcaagcactttctctgcttttttgtatcttatcttggacacttatgctgaattatgttcttattattttcactggttataagctattccttgtacataatatttaaactatccaaatatccagcatacatttccatgtggctgccatcggctgttgatgccatgaatgaaatggctggttagaaagccaaaggtcttcttttttcaattcctaatgaataagtaaaatgccagatctctttggtctcaaagcaaattgctctgatcagatcaaatatctatgtaatgaaaagagacttacttaaatttgggattctgcttaaactttaagttgaatttgactgtagtcattcattctttttatatatctctgtcaggtatgacattaattaccaggtggtattatactctactttgagtttggacatcactttcagttaaatttctgttgttattgtggcttttttttttttttaaccccactgaagatggaagtagagcagtctgccatctcctgctgttctttctctgtgccccctaattgcttggtaatctaaaattattctgactttccacatactgtctttaaaaaccaattgtagcaatctgcccgcctccaccctttaagctaaatctttcactgtgctggatacatagacactcgataaatgtgtgatgatagttctaaaataattatgctatatatcagggttctgtatttttgagcaatatcattattcctatgctgtgatgttaaatggaatttattttacactagtaatagactgcttaagtggctgatttgaaacctttctctaaaaaaacaaaaacatctggcagatgagtgacacaaattcattctcttaaaggatagaatttcaagttaaggataaggcacaataaataggcacatagaggacatctgtttttgtttttggtttgggttttgtttttttttggtctctctgactagctaaactgccaactagaagaatggttgttatgtagtaactcagaagaatcttttaataagtttcttctttggtttcaaaacaaacttgagcttcatttcttgccacctctattctttcttcccacgttgggtgactgaactgatgcttattctagttttagaagaggatccacatttaatgtaaggcataaatatgccttttgcaaattattgcttgttctccagtgaacatttgatcatattcaacagaaatccaccatataaaccataatccttgaattgccccttttaaaatagattggttaaaaccaaaaacctataagagagaaatgatatttcattgtattgtaggtttgggaatcctggttagatttataatttctggccgggtgcggtggctcatgcctgtattcccagtactttgggagcccaaggtgggtggatcacctgaggtaaggagtttgagaccagcctggccaacatggtgaaaccccatctctactaaaaatacaaaaagttagctgggcatggtggtgcgcgcctgtggtcccagctactcgggaggctgaggtgggagaatcccttgaacccaggaggcagaagttgcagtgagctgagatcatgccattgcactccagcctgggcaacagagcgagacttcatctccaaaaaaagaaaaagaagaaaaagatttataatttctgagtcccctaagtccctttctcagtttgcaataatcttacgtccatgctattgacactaattttgaaactggaaagctaattaatgacatattcatgtgttctttcatctaataaacatttattaatgtatagttctacaccaggcattctgaagggtccaaaagaaagttcctgccctctagtagcacataatccgttatttctcagcacaccatgccatctgtttatcattcagcagttaagtaattcatcacttcatatttttaccaaagtatatttacaagtctgtttatctggatctggcaaactggaaaatgtttgaagggatactcaggctttgatccatgccaacatgaaaggactccaagcacatttaagtaggctggtcttttcatcatgcatgattttttttttagtgcaaatttagactttagtttgggaaagagaacagtatacagtatcctttgtaagataaatcacaacaacaaaaattaagttttattgcacaaagtagataaatgagaaagtctttcttaaaaaatgcttctttaactgtaacagcaaaactaaatgcatattttatcaaccccttatttctaattgctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcactttagcccaggaggtccagaccagcctgggcaacacagcgggaccccgactccatttaaaaaattaaaaaaaaaaaaaaaacttttaacatttaaaaaataaaaattaacaaaatttcacttattccaggacacgctggcatttggactcaatgaaaagggcacctaaagaaaataaggctgactgaatgttttccataattttcacacaataacagtccctttctatccagcttgccttccatttatctctagggttagcttttcaggcaacatccttggtcattgcccagaaagtacctgagctatcagtgattggaatggcacaggaaaccgaatcacatgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtcacgtgggttgttt

SEQ ID NO: 312391 - DNA, 3323 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggttcgtagctatccacaccaacataatggctctcctcccacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttatgcttaccaaatgtgccttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggttgtggactatgtttactttcccaagttggggttttcttaaagattcccggaaggtattgtgactcccttttgtcccagggggaatttttggtttctggactttccggaattggggtaaaacatcgg

SEQ ID NO: 312392 - DNA, 4301 bp, Homo sapiens
accccactgaagatggaagtagagcagtctgccatctcctgctgttctttctctgtgccccctaattgcttggtaatctaaaattattctgactttccacatactgtctttaaaaaccaattgtagcaatctgcccgcctccaccctttaagctaaatctttcactgtgctgggattacagatgtgagccactgcacctggccccagaaattatgcttaaaaaaaaaattaagctgtgtggaatctggacaaggctatgtttctcctagaaacaggttttgctgtaaatggttttgatgggcgaaagtgtgagaaaaggttataatagattcttttttttaattttgtgagaaattccaggtcttcttgcttaacttatatgcatgtggatatatttgttttcaaagccatggaagaatctctgttcatatattttaatgcaaattaccttgtatgctgctatgcaaattctattaaaaggcctacctgcttaagaattaaacatttttgaaactttcagggaagacctgtagactcaagcactttctctgcttttttgtatcttatcttggacacttatgctgaattatgttcttattattttcactggttataagctattccttgtacataatatttaaactatccaaatatccagcatacatttccatgtggctgccatcggctgttgatgccatgaatgaaatggctggttagaaagccaaaggtcttcttttttcaattcctaatgaataagtaaaatgccagatctctttggtctcaaagcaaattgctctgatcagatcaaatatctatgtaatgaaaagagacttacttaaatttgggattctgcttaaactttaagttgaatttgactgtagtcattcattctttttatatatctctgtcaggtatgacattaattaccaggtggtattatactctactttgagtttggacatcactttcagttaaatttctgttgttattgtggcttttttttttttttaaccccactgaagatggaagtagagcagtctgccatctcctgctgttctttctctgtgccccctaattgcttggtaatctaaaattattctgactttccacatactgtctttaaaaaccaattgtagcaatctgcccgcctccaccctttaagctaaatctttcactgtgctggatacatagacactcgataaatgtgtgatgatagttctaaaataattatgctatatatcagggttctgtatttttgagcaatatcattattcctatgctgtgatgttaaatggaatttattttacactagtaatagactgcttaagtggctgatttgaaacctttctctaaaaaaacaaaaacatctggcagatgagtgacacaaattcattctcttaaaggatagaatttcaagttaaggataaggcacaataaataggcacatagaggacatctgtttttgtttttggtttgggttttgtttttttttggtctctctgactagctaaactgccaactagaagaatggttgttatgtagtaactcagaagaatcttttaataagtttcttctttggtttcaaaacaaacttgagcttcatttcttgccacctctattctttcttcccacgttgggtgactgaactgatgcttattctagttttagaagaggatccacatttaatgtaaggcataaatatgccttttgcaaattattgcttgttctccagtgaacatttgatcatattcaacagaaatccaccatataaaccataatccttgaattgccccttttaaaatagattggttaaaaccaaaaacctataagagagaaatgatatttcattgtattgtaggtttgggaatcctggttagatttataatttctggccgggtgcggtggctcatgcctgtattcccagtactttgggagcccaaggtgggtggatcacctgaggtaaggagtttgagaccagcctggccaacatggtgaaaccccatctctactaaaaatacaaaaagttagctgggcatggtggtgcgcgcctgtggtcccagctactcgggaggctgaggtgggagaatcccttgaacccaggaggcagaagttgcagtgagctgagatcatgccattgcactccagcctgggcaacagagcgagacttcatctccaaaaaaagaaaaagaagaaaaagatttataatttctgagtcccctaagtccctttctcagtttgcaataatcttacgtccatgctattgacactaattttgaaactggaaagctaattaatgacatattcatgtgttctttcatctaataaacatttattaatgtatagttctacaccaggcattctgaagggtccaaaagaaagttcctgccctctagtagcacataatccgttatttctcagcacaccatgccatctgtttatcattcagcagttaagtaattcatcacttcatatttttaccaaagtatatttacaagtctgtttatctggatctggcaaactggaaaatgtttgaagggatactcaggctttgatccatgccaacatgaaaggactccaagcacatttaagtaggctggtcttttcatcatgcatgattttttttttagtgcaaatttagactttagtttgggaaagagaacagtatacagtatcctttgtaagataaatcacaacaacaaaaattaagttttattgcacaaagtagataaatgagaaagtctttcttaaaaaatgcttctttaactgtaacagcaaaactaaatgcatattttatcaaccccttatttctaattgctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcactttagcccaggaggtccagaccagcctgggcaacacagcgggaccccgactccatttaaaaaattaaaaaaaaaaaaaaaacttttaacatttaaaaaataaaaattaacaaaatttcacttattccaggacacgctggcatttggactcaatgaaaagggcacctaaagaaaataaggctgactgaatgttttccataattttcacacaataacagtccctttctatccagcttgccttccatttatctctagggttagcttttcaggcaacatccttggtcattgcccagaaagtacctgagctatcagtgattggaatggcacaggaaaccgaatcacatgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtcacgtgggttgttt

SEQ ID NO: 312393 - DNA, 1002 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggtaagtaagactaaagataaggaagtaaaatatttatcctactct

SEQ ID NO: 312394 - DNA, 1003 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggagggtgagcggggccgggcgggagggtgggcaggccgcggcggcctgggctcgcgggagctcactttgttcctgccccgccggcggggcgagccggttctctccccgtctctctccaaacccgggtttctggagctttcagtgtggaaaaacggatgcttcttgcaggaaaagttgggcagccgccgaagtgtggcttgcagcccctagggaagactcggctgagattgagtaaaaagcagctgcctatgaagccccacctcggcccgataagctgacactaagaacttgagggagagcgaacggctcgagtgggtctgtctccgtttgcccgctgagaagtgccgggttggcgcttaactcactcacctctggctcctcggggcgggcgggtctattaaaaaaaa

SEQ ID NO: 312395 - DNA, 9780 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggttcgtagctatccacaccaacataatggctctcctcccacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttatgcttaccaaatgtgccttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggtggaggagggtgtcacttcagatggggcaggcacagggggagaaaagaagagaaaaacacacctgtgtgcaaaatgagctatttggtttcagtgcggcctgaccgatggggaggacccatgagcagagagagttctaggtcaacattgtaactccattgtcctccttcacccataagtcagtcctccttcctcattacagtgaaaccaacaatatgcagaggttggggagagatgcctgttcttcccccagcttcatataattgtcaaagttccaaaaatgaattatctgaactgcttaaaactggaaattaaaatctagacaagaatatgtctttcaagagctttttatgttttgaaagttcataaacctaagattggctccatctgagataaattttcttttctttttttttttgagacggagtctcgttctgtctcccaggctggagtgcagtggcatgatctcggctcactgcaacctccacctcctaggttcaagtgattctcctgagtagctggggttatagctacccaccaccacacccagctaatttttgtatttttagtagaggcaggttttcaccatgttggctaggctggtcttgaactcccgacctcaagtgatccacctgccttggcctcccaaagtgctgggattataggtgtgagcccccgtgcctggcccacaataaattttcatttcagagaaggaaaaaaatctcttgaacgtccagaaatgatttctggaatcagaatttcaatatgtaataccctcaggtaggcaatcttgaaccctctatgcagtgagagcattattaatatgagatgttgaatgatgcctttacagacttcagcagcaaagccatttggttgaggttttctgtgttaatgtgaaaagctaagccactgagatttgcaggggagcttctgagccaccctgcttgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttccagctgaatgaatgcacttagctgataaaccagaatttgttcttttttttccttctttttttttggagacaggttctcactctgtcaccgaggttggagtgcagtggtatgatcatagctgactgcagcctcaaccttctgggctcaaatgatcctttcacctcagcctcctgagtagctgggaccacaggtgtgtgccaccacacctggctaatttttatggatttttttttcttttttttttttcgccatgttgcccaggctggtcttgaactcttggcactcaagcagtccttctgcctcagcctcccaaagtgctgggattacagatgtgagccactgcacctggccccagaaattatgcttaaaaaaaaaattaagctgtgtggaatctggacaaggctatgtttctcctagaaacaggttttgctgtaaatggttttgatgggcgaaagtgtgagaaaaggttataatagattcttttttttaattttgtgagaaattccaggtcttcttgcttaacttatatgcatgtggatatatttgttttcaaagccatggaagaatctctgttcatatattttaatgcaaattaccttgtatgctgctatgcaaattctattaaaaggcctacctgcttaagaattaaacatttttgaaactttcagggaagacctgtagactcaagcactttctctgcttttttgtatcttatcttggacacttatgctgaattatgttcttattattttcactggttataagctattccttgtacataatatttaaactatccaaatatccagcatacatttccatgtggctgccatcggctgttgatgccatgaatgaaatggctggttagaaagccaaaggtcttcttttttcaattcctaatgaataagtaaaatgccagatctctttggtctcaaagcaaattgctctgatcagatcaaatatctatgtaatgaaaagagacttacttaaatttgggattctgcttaaactttaagttgaatttgactgtagtcattcattctttttatatatctctgtcaggtatgacattaattaccaggtggtattatactctactttgagtttggacatcactttcagttaaatttctgttgttattgtggcttttttttttttttaaccccactgaagatggaagtagagcagtctgccatctcctgctgttctttctctgtgccccctaattgcttggtaatctaaaattattctgactttccacatactgtctttaaaaaccaattgtagcaatctgcccgcctccaccctttaagctaaatctttcactgtgctggatacatagacactcgataaatgtgtgatgatagttctaaaataattatgctatatatcagggttctgtatttttgagcaatatcattattcctatgctgtgatgttaaatggaatttattttacactagtaatagactgcttaagtggctgatttgaaacctttctctaaaaaaacaaaaacatctggcagatgagtgacacaaattcattctcttaaaggatagaatttcaagttaaggataaggcacaataaataggcacatagaggacatctgtttttgtttttggtttgggttttgtttttttttggtctctctgactagctaaactgccaactagaagaatggttgttatgtagtaactcagaagaatcttttaataagtttcttctttggtttcaaaacaaacttgagcttcatttcttgccacctctattctttcttcccacgttgggtgactgaactgatgcttattctagttttagaagaggatccacatttaatgtaaggcataaatatgccttttgcaaattattgcttgttctccagtgaacatttgatcatattcaacagaaatccaccatataaaccataatccttgaattgccccttttaaaatagattggttaaaaccaaaaacctataagagagaaatgatatttcattgtattgtaggtttgggaatcctggttagatttataatttctggccgggtgcggtggctcatgcctgtattcccagtactttgggagcccaaggtgggtggatcacctgaggtaaggagtttgagaccagcctggccaacatggtgaaaccccatctctactaaaaatacaaaaagttagctgggcatggtggtgcgcgcctgtggtcccagctactcgggaggctgaggtgggagaatcccttgaacccaggaggcagaagttgcagtgagctgagatcatgccattgcactccagcctgggcaacagagcgagacttcatctccaaaaaaagaaaaagaagaaaaagatttataatttctgagtcccctaagtccctttctcagtttgcaataatcttacgtccatgctattgacactaattttgaaactggaaagctaattaatgacatattcatgtgttctttcatctaataaacatttattaatgtatagttctacaccaggcattctgaagggtccaaaagaaagttcctgccctctagtagcacataatccgttatttctcagcacaccatgccatctgtttatcattcagcagttaagtaattcatcacttcatatttttaccaaagtatatttacaagtctgtttatctggatctggcaaactggaaaatgtttgaagggatactcaggctttgatccatgccaacatgaaaggactccaagcacatttaagtaggctggtcttttcatcatgcatgattttttttttagtgcaaatttagactttagtttgggaaagagaacagtatacagtatcctttgtaagataaatcacaacaacaaaaattaagttttattgcacaaagtagataaatgagaaagtctttcttaaaaaatgcttctttaactgtaacagcaaaactaaatgcatattttatcaaccccttatttctaattgctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcactttagcccaggaggtccagaccagcctgggcaacacagcgggaccccgactccatttaaaaaattaaaaaaaaaaaaaaaacttttaacatttaaaaaataaaaattaacaaaatttcacttattccaggacacgctggcatttggactcaatgaaaagggcacctaaagaaaataaggctgactgaatgttttccataattttcacacaataacagtccctttctatccagcttgccttccatttatctctagggttagcttttcaggcaacatccttggtcattgcccagaaagtacctgagctatcagtgattggaatggcacaggaaaccgaatcacatgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtcacgtgggttgttt

SEQ ID NO: 312396 - DNA, 9569 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttatgcttaccaaatgtgccttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggtggaggagggtgtcacttcagatggggcaggcacagggggagaaaagaagagaaaaacacacctgtgtgcaaaatgagctatttggtttcagtgcggcctgaccgatggggaggacccatgagcagagagagttctaggtcaacattgtaactccattgtcctccttcacccataagtcagtcctccttcctcattacagtgaaaccaacaatatgcagaggttggggagagatgcctgttcttcccccagcttcatataattgtcaaagttccaaaaatgaattatctgaactgcttaaaactggaaattaaaatctagacaagaatatgtctttcaagagctttttatgttttgaaagttcataaacctaagattggctccatctgagataaattttcttttctttttttttttgagacggagtctcgttctgtctcccaggctggagtgcagtggcatgatctcggctcactgcaacctccacctcctaggttcaagtgattctcctgagtagctggggttatagctacccaccaccacacccagctaatttttgtatttttagtagaggcaggttttcaccatgttggctaggctggtcttgaactcccgacctcaagtgatccacctgccttggcctcccaaagtgctgggattataggtgtgagcccccgtgcctggcccacaataaattttcatttcagagaaggaaaaaaatctcttgaacgtccagaaatgatttctggaatcagaatttcaatatgtaataccctcaggtaggcaatcttgaaccctctatgcagtgagagcattattaatatgagatgttgaatgatgcctttacagacttcagcagcaaagccatttggttgaggttttctgtgttaatgtgaaaagctaagccactgagatttgcaggggagcttctgagccaccctgcttgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttccagctgaatgaatgcacttagctgataaaccagaatttgttcttttttttccttctttttttttggagacaggttctcactctgtcaccgaggttggagtgcagtggtatgatcatagctgactgcagcctcaaccttctgggctcaaatgatcctttcacctcagcctcctgagtagctgggaccacaggtgtgtgccaccacacctggctaatttttatggatttttttttcttttttttttttcgccatgttgcccaggctggtcttgaactcttggcactcaagcagtccttctgcctcagcctcccaaagtgctgggattacagatgtgagccactgcacctggccccagaaattatgcttaaaaaaaaaattaagctgtgtggaatctggacaaggctatgtttctcctagaaacaggttttgctgtaaatggttttgatgggcgaaagtgtgagaaaaggttataatagattcttttttttaattttgtgagaaattccaggtcttcttgcttaacttatatgcatgtggatatatttgttttcaaagccatggaagaatctctgttcatatattttaatgcaaattaccttgtatgctgctatgcaaattctattaaaaggcctacctgcttaagaattaaacatttttgaaactttcagggaagacctgtagactcaagcactttctctgcttttttgtatcttatcttggacacttatgctgaattatgttcttattattttcactggttataagctattccttgtacataatatttaaactatccaaatatccagcatacatttccatgtggctgccatcggctgttgatgccatgaatgaaatggctggttagaaagccaaaggtcttcttttttcaattcctaatgaataagtaaaatgccagatctctttggtctcaaagcaaattgctctgatcagatcaaatatctatgtaatgaaaagagacttacttaaatttgggattctgcttaaactttaagttgaatttgactgtagtcattcattctttttatatatctctgtcaggtatgacattaattaccaggtggtattatactctactttgagtttggacatcactttcagttaaatttctgttgttattgtggcttttttttttttttaaccccactgaagatggaagtagagcagtctgccatctcctgctgttctttctctgtgccccctaattgcttggtaatctaaaattattctgactttccacatactgtctttaaaaaccaattgtagcaatctgcccgcctccaccctttaagctaaatctttcactgtgctggatacatagacactcgataaatgtgtgatgatagttctaaaataattatgctatatatcagggttctgtatttttgagcaatatcattattcctatgctgtgatgttaaatggaatttattttacactagtaatagactgcttaagtggctgatttgaaacctttctctaaaaaaacaaaaacatctggcagatgagtgacacaaattcattctcttaaaggatagaatttcaagttaaggataaggcacaataaataggcacatagaggacatctgtttttgtttttggtttgggttttgtttttttttggtctctctgactagctaaactgccaactagaagaatggttgttatgtagtaactcagaagaatcttttaataagtttcttctttggtttcaaaacaaacttgagcttcatttcttgccacctctattctttcttcccacgttgggtgactgaactgatgcttattctagttttagaagaggatccacatttaatgtaaggcataaatatgccttttgcaaattattgcttgttctccagtgaacatttgatcatattcaacagaaatccaccatataaaccataatccttgaattgccccttttaaaatagattggttaaaaccaaaaacctataagagagaaatgatatttcattgtattgtaggtttgggaatcctggttagatttataatttctggccgggtgcggtggctcatgcctgtattcccagtactttgggagcccaaggtgggtggatcacctgaggtaaggagtttgagaccagcctggccaacatggtgaaaccccatctctactaaaaatacaaaaagttagctgggcatggtggtgcgcgcctgtggtcccagctactcgggaggctgaggtgggagaatcccttgaacccaggaggcagaagttgcagtgagctgagatcatgccattgcactccagcctgggcaacagagcgagacttcatctccaaaaaaagaaaaagaagaaaaagatttataatttctgagtcccctaagtccctttctcagtttgcaataatcttacgtccatgctattgacactaattttgaaactggaaagctaattaatgacatattcatgtgttctttcatctaataaacatttattaatgtatagttctacaccaggcattctgaagggtccaaaagaaagttcctgccctctagtagcacataatccgttatttctcagcacaccatgccatctgtttatcattcagcagttaagtaattcatcacttcatatttttaccaaagtatatttacaagtctgtttatctggatctggcaaactggaaaatgtttgaagggatactcaggctttgatccatgccaacatgaaaggactccaagcacatttaagtaggctggtcttttcatcatgcatgattttttttttagtgcaaatttagactttagtttgggaaagagaacagtatacagtatcctttgtaagataaatcacaacaacaaaaattaagttttattgcacaaagtagataaatgagaaagtctttcttaaaaaatgcttctttaactgtaacagcaaaactaaatgcatattttatcaaccccttatttctaattgctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcactttagcccaggaggtccagaccagcctgggcaacacagcgggaccccgactccatttaaaaaattaaaaaaaaaaaaaaaacttttaacatttaaaaaataaaaattaacaaaatttcacttattccaggacacgctggcatttggactcaatgaaaagggcacctaaagaaaataaggctgactgaatgttttccataattttcacacaataacagtccctttctatccagcttgccttccatttatctctagggttagcttttcaggcaacatccttggtcattgcccagaaagtacctgagctatcagtgattggaatggcacaggaaaccgaatcacatgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtcacgtgggttgttt

SEQ ID NO: 312397 - DNA, 9866 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggagggcctataatgaggaaatttctgtctgaccaatatcaggggcacatcagctgctgtactaagtttcttcaaatatcctggaattgtgtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggttcgtagctatccacaccaacataatggctctcctcccacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttatgcttaccaaatgtgccttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggtggaggagggtgtcacttcagatggggcaggcacagggggagaaaagaagagaaaaacacacctgtgtgcaaaatgagctatttggtttcagtgcggcctgaccgatggggaggacccatgagcagagagagttctaggtcaacattgtaactccattgtcctccttcacccataagtcagtcctccttcctcattacagtgaaaccaacaatatgcagaggttggggagagatgcctgttcttcccccagcttcatataattgtcaaagttccaaaaatgaattatctgaactgcttaaaactggaaattaaaatctagacaagaatatgtctttcaagagctttttatgttttgaaagttcataaacctaagattggctccatctgagataaattttcttttctttttttttttgagacggagtctcgttctgtctcccaggctggagtgcagtggcatgatctcggctcactgcaacctccacctcctaggttcaagtgattctcctgagtagctggggttatagctacccaccaccacacccagctaatttttgtatttttagtagaggcaggttttcaccatgttggctaggctggtcttgaactcccgacctcaagtgatccacctgccttggcctcccaaagtgctgggattataggtgtgagcccccgtgcctggcccacaataaattttcatttcagagaaggaaaaaaatctcttgaacgtccagaaatgatttctggaatcagaatttcaatatgtaataccctcaggtaggcaatcttgaaccctctatgcagtgagagcattattaatatgagatgttgaatgatgcctttacagacttcagcagcaaagccatttggttgaggttttctgtgttaatgtgaaaagctaagccactgagatttgcaggggagcttctgagccaccctgcttgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttccagctgaatgaatgcacttagctgataaaccagaatttgttcttttttttccttctttttttttggagacaggttctcactctgtcaccgaggttggagtgcagtggtatgatcatagctgactgcagcctcaaccttctgggctcaaatgatcctttcacctcagcctcctgagtagctgggaccacaggtgtgtgccaccacacctggctaatttttatggatttttttttcttttttttttttcgccatgttgcccaggctggtcttgaactcttggcactcaagcagtccttctgcctcagcctcccaaagtgctgggattacagatgtgagccactgcacctggccccagaaattatgcttaaaaaaaaaattaagctgtgtggaatctggacaaggctatgtttctcctagaaacaggttttgctgtaaatggttttgatgggcgaaagtgtgagaaaaggttataatagattcttttttttaattttgtgagaaattccaggtcttcttgcttaacttatatgcatgtggatatatttgttttcaaagccatggaagaatctctgttcatatattttaatgcaaattaccttgtatgctgctatgcaaattctattaaaaggcctacctgcttaagaattaaacatttttgaaactttcagggaagacctgtagactcaagcactttctctgcttttttgtatcttatcttggacacttatgctgaattatgttcttattattttcactggttataagctattccttgtacataatatttaaactatccaaatatccagcatacatttccatgtggctgccatcggctgttgatgccatgaatgaaatggctggttagaaagccaaaggtcttcttttttcaattcctaatgaataagtaaaatgccagatctctttggtctcaaagcaaattgctctgatcagatcaaatatctatgtaatgaaaagagacttacttaaatttgggattctgcttaaactttaagttgaatttgactgtagtcattcattctttttatatatctctgtcaggtatgacattaattaccaggtggtattatactctactttgagtttggacatcactttcagttaaatttctgttgttattgtggcttttttttttttttaaccccactgaagatggaagtagagcagtctgccatctcctgctgttctttctctgtgccccctaattgcttggtaatctaaaattattctgactttccacatactgtctttaaaaaccaattgtagcaatctgcccgcctccaccctttaagctaaatctttcactgtgctggatacatagacactcgataaatgtgtgatgatagttctaaaataattatgctatatatcagggttctgtatttttgagcaatatcattattcctatgctgtgatgttaaatggaatttattttacactagtaatagactgcttaagtggctgatttgaaacctttctctaaaaaaacaaaaacatctggcagatgagtgacacaaattcattctcttaaaggatagaatttcaagttaaggataaggcacaataaataggcacatagaggacatctgtttttgtttttggtttgggttttgtttttttttggtctctctgactagctaaactgccaactagaagaatggttgttatgtagtaactcagaagaatcttttaataagtttcttctttggtttcaaaacaaacttgagcttcatttcttgccacctctattctttcttcccacgttgggtgactgaactgatgcttattctagttttagaagaggatccacatttaatgtaaggcataaatatgccttttgcaaattattgcttgttctccagtgaacatttgatcatattcaacagaaatccaccatataaaccataatccttgaattgccccttttaaaatagattggttaaaaccaaaaacctataagagagaaatgatatttcattgtattgtaggtttgggaatcctggttagatttataatttctggccgggtgcggtggctcatgcctgtattcccagtactttgggagcccaaggtgggtggatcacctgaggtaaggagtttgagaccagcctggccaacatggtgaaaccccatctctactaaaaatacaaaaagttagctgggcatggtggtgcgcgcctgtggtcccagctactcgggaggctgaggtgggagaatcccttgaacccaggaggcagaagttgcagtgagctgagatcatgccattgcactccagcctgggcaacagagcgagacttcatctccaaaaaaagaaaaagaagaaaaagatttataatttctgagtcccctaagtccctttctcagtttgcaataatcttacgtccatgctattgacactaattttgaaactggaaagctaattaatgacatattcatgtgttctttcatctaataaacatttattaatgtatagttctacaccaggcattctgaagggtccaaaagaaagttcctgccctctagtagcacataatccgttatttctcagcacaccatgccatctgtttatcattcagcagttaagtaattcatcacttcatatttttaccaaagtatatttacaagtctgtttatctggatctggcaaactggaaaatgtttgaagggatactcaggctttgatccatgccaacatgaaaggactccaagcacatttaagtaggctggtcttttcatcatgcatgattttttttttagtgcaaatttagactttagtttgggaaagagaacagtatacagtatcctttgtaagataaatcacaacaacaaaaattaagttttattgcacaaagtagataaatgagaaagtctttcttaaaaaatgcttctttaactgtaacagcaaaactaaatgcatattttatcaaccccttatttctaattgctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcactttagcccaggaggtccagaccagcctgggcaacacagcgggaccccgactccatttaaaaaattaaaaaaaaaaaaaaaacttttaacatttaaaaaataaaaattaacaaaatttcacttattccaggacacgctggcatttggactcaatgaaaagggcacctaaagaaaataaggctgactgaatgttttccataattttcacacaataacagtccctttctatccagcttgccttccatttatctctagggttagcttttcaggcaacatccttggtcattgcccagaaagtacctgagctatcagtgattggaatggcacaggaaaccgaatcacatgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtcacgtgggttgttt

SEQ ID NO: 312398 - DNA, 9348 bp, Homo sapiens
cgaatgctgctctatgatgtatgccgtggacaagagatgcctgggcgtcaccatgccacagctacccacttgtagccaccaggcctataatgaggaaatttctgtctgaccaatatcaggggcacatcagctgctgtactaagtttcttcaaatatcctggaattgtgtcaagttcatccgagaagtaacaccatatatcaagaagccatcattagtatcagatctgccgtgggaaggtgcagccccccagtcaccaagctttagtggcagtgaggactctggttcgccaaaacaccagaacagcaccaaggacaggaagatcatccctctcaaaatgtgctttgctgctagaaacctaagcatgccggatctggaaaacagattgatagagctacattctcctgatagcaggaacacgttgatcctacgctgcaaagatacagccacagcacactcctggttcgtagctatccacaccaacataatggctctcctcccacaggtgttggctgaactcaacgccatgcttggggcaaccagtacagcaggaggcagtaaagaggtgaagcatattgcctggctggcagaacaggcaaaactagatggtggaagacagcaatggagacctgtcctcatggctgtgactgagaaggatttgctgctctatgactgtatgccgtggacaagagatgcctgggcgtcaccatgccacagctacccacttgttgccaccaggttggttcattctggctccggatgtcgatccccctcccttggatctgaccttacatttgctaccaggacaggctctcgacagggcattgagatgcatctcttcagggtggagacacatcgggatctgtcatcctggaccaggatacttgttcagggttgccatgctgctgctgagctgatcaaggaagtctctctaggctgcatgttaaatggccaagaggtgaggcttactattcactatgaaaatgggttcaccatctcaagggaaaatggaggctccagcagcatattgtaccgctacccctttgaaaggctgaagatgtctgctgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttatgcttaccaaatgtgccttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggtggaggagggtgtcacttcagatggggcaggcacagggggagaaaagaagagaaaaacacacctgtgtgcaaaatgagctatttggtttcagtgcggcctgaccgatggggaggacccatgagcagagagagttctaggtcaacattgtaactccattgtcctccttcacccataagtcagtcctccttcctcattacagtgaaaccaacaatatgcagaggttggggagagatgcctgttcttcccccagcttcatataattgtcaaagttccaaaaatgaattatctgaactgcttaaaactggaaattaaaatctagacaagaatatgtctttcaagagctttttatgttttgaaagttcataaacctaagattggctccatctgagataaattttcttttctttttttttttgagacggagtctcgttctgtctcccaggctggagtgcagtggcatgatctcggctcactgcaacctccacctcctaggttcaagtgattctcctgagtagctggggttatagctacccaccaccacacccagctaatttttgtatttttagtagaggcaggttttcaccatgttggctaggctggtcttgaactcccgacctcaagtgatccacctgccttggcctcccaaagtgctgggattataggtgtgagcccccgtgcctggcccacaataaattttcatttcagagaaggaaaaaaatctcttgaacgtccagaaatgatttctggaatcagaatttcaatatgtaataccctcaggtaggcaatcttgaaccctctatgcagtgagagcattattaatatgagatgttgaatgatgcctttacagacttcagcagcaaagccatttggttgaggttttctgtgttaatgtgaaaagctaagccactgagatttgcaggggagcttctgagccaccctgcttgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttccagctgaatgaatgcacttagctgataaaccagaatttgttcttttttttccttctttttttttggagacaggttctcactctgtcaccgaggttggagtgcagtggtatgatcatagctgactgcagcctcaaccttctgggctcaaatgatcctttcacctcagcctcctgagtagctgggaccacaggtgtgtgccaccacacctggctaatttttatggatttttttttcttttttttttttcgccatgttgcccaggctggtcttgaactcttggcactcaagcagtccttctgcctcagcctcccaaagtgctgggattacagatgtgagccactgcacctggccccagaaattatgcttaaaaaaaaaattaagctgtgtggaatctggacaaggctatgtttctcctagaaacaggttttgctgtaaatggttttgatgggcgaaagtgtgagaaaaggttataatagattcttttttttaattttgtgagaaattccaggtcttcttgcttaacttatatgcatgtggatatatttgttttcaaagccatggaagaatctctgttcatatattttaatgcaaattaccttgtatgctgctatgcaaattctattaaaaggcctacctgcttaagaattaaacatttttgaaactttcagggaagacctgtagactcaagcactttctctgcttttttgtatcttatcttggacacttatgctgaattatgttcttattattttcactggttataagctattccttgtacataatatttaaactatccaaatatccagcatacatttccatgtggctgccatcggctgttgatgccatgaatgaaatggctggttagaaagccaaaggtcttcttttttcaattcctaatgaataagtaaaatgccagatctctttggtctcaaagcaaattgctctgatcagatcaaatatctatgtaatgaaaagagacttacttaaatttgggattctgcttaaactttaagttgaatttgactgtagtcattcattctttttatatatctctgtcaggtatgacattaattaccaggtggtattatactctactttgagtttggacatcactttcagttaaatttctgttgttattgtggcttttttttttttttaaccccactgaagatggaagtagagcagtctgccatctcctgctgttctttctctgtgccccctaattgcttggtaatctaaaattattctgactttccacatactgtctttaaaaaccaattgtagcaatctgcccgcctccaccctttaagctaaatctttcactgtgctggatacatagacactcgataaatgtgtgatgatagttctaaaataattatgctatatatcagggttctgtatttttgagcaatatcattattcctatgctgtgatgttaaatggaatttattttacactagtaatagactgcttaagtggctgatttgaaacctttctctaaaaaaacaaaaacatctggcagatgagtgacacaaattcattctcttaaaggatagaatttcaagttaaggataaggcacaataaataggcacatagaggacatctgtttttgtttttggtttgggttttgtttttttttggtctctctgactagctaaactgccaactagaagaatggttgttatgtagtaactcagaagaatcttttaataagtttcttctttggtttcaaaacaaacttgagcttcatttcttgccacctctattctttcttcccacgttgggtgactgaactgatgcttattctagttttagaagaggatccacatttaatgtaaggcataaatatgccttttgcaaattattgcttgttctccagtgaacatttgatcatattcaacagaaatccaccatataaaccataatccttgaattgccccttttaaaatagattggttaaaaccaaaaacctataagagagaaatgatatttcattgtattgtaggtttgggaatcctggttagatttataatttctggccgggtgcggtggctcatgcctgtattcccagtactttgggagcccaaggtgggtggatcacctgaggtaaggagtttgagaccagcctggccaacatggtgaaaccccatctctactaaaaatacaaaaagttagctgggcatggtggtgcgcgcctgtggtcccagctactcgggaggctgaggtgggagaatcccttgaacccaggaggcagaagttgcagtgagctgagatcatgccattgcactccagcctgggcaacagagcgagacttcatctccaaaaaaagaaaaagaagaaaaagatttataatttctgagtcccctaagtccctttctcagtttgcaataatcttacgtccatgctattgacactaattttgaaactggaaagctaattaatgacatattcatgtgttctttcatctaataaacatttattaatgtatagttctacaccaggcattctgaagggtccaaaagaaagttcctgccctctagtagcacataatccgttatttctcagcacaccatgccatctgtttatcattcagcagttaagtaattcatcacttcatatttttaccaaagtatatttacaagtctgtttatctggatctggcaaactggaaaatgtttgaagggatactcaggctttgatccatgccaacatgaaaggactccaagcacatttaagtaggctggtcttttcatcatgcatgattttttttttagtgcaaatttagactttagtttgggaaagagaacagtatacagtatcctttgtaagataaatcacaacaacaaaaattaagttttattgcacaaagtagataaatgagaaagtctttcttaaaaaatgcttctttaactgtaacagcaaaactaaatgcatattttatcaaccccttatttctaattgctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcactttagcccaggaggtccagaccagcctgggcaacacagcgggaccccgactccatttaaaaaattaaaaaaaaaaaaaaaacttttaacatttaaaaaataaaaattaacaaaatttcacttattccaggacacgctggcatttggactcaatgaaaagggcacctaaagaaaataaggctgactgaatgttttccataattttcacacaataacagtccctttctatccagcttgccttccatttatctctagggttagcttttcaggcaacatccttggtcattgcccagaaagtacctgagctatcagtgattggaatggcacaggaaaccgaatcacatgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtcacgtgggttgttt

SEQ ID NO: 312399 - DNA, 8885 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcgcgggcgactcgctgcccgggagcccaagccgcggcctggggcccccgagcccgccggcgccgcctcggggccccgcgggtgaggcgggcgcgtcgccgcccgtgcgccgggtgcgggtggtgaagcaagaggcgggcggcctgggcatcagcatcaagggcggccgcgagaaccggatgccgatcctcatctccaagatcttccccgggctggctgccgaccagagccgggcgctgcggctgggcgacgccatcctgtcggtgaacggcaccgacctgcgccaggccacccacgaccaggccgtgcaggcgctgaagcgcgcgggcaaggaggtgctgctggaggtgatgatggcatccgaaatctatacttggattttggtggtcccgagggagaactgaccatggacctgcactcttgtccgaagccgattgtatttgtgttgcacacgtttttatcggccaaagtcactcgtatgggactgcttgtatgagcaacaaaaaatcagaaaagagccttgactgtcacaagaaatatttccacctcaaaaaaaaaagcacaaaaagaaactctttgctctccttcagcacagtgccttcccaaggacctgcaaataactgctgaaccataaccgtgtttaaagaagagcctacctttcacagtctaccttggccagatattctagcactctaaaaggctccaaaatgaagctgttgatttattctcatttcaaaatatggtttatgagtaattaggtttatttctactgctaaaaagaatggctcattgttttctttttttttcattgttttcatttttagacataatcaaatacccaagcattgttttctttttcttctccctgtaggatttgtgttgtgcttagccttgatctcttgttcagaacaattgtcccttcccaggtgctagcttgcagcagcctgttgcttcctgagcattccagataggtcgtatgtcttggaatttactgtcctcactagctccttccaccataggaagtccttgaattgtatcaccaaagggttgttccatttgccctggatctccctctatctcagcctggccatcacttcccaccttatcccaagctttgccactgtctctaggacttagaacttgtaaatttgatttgccttgccttctacttcctttctagtggtgactgagttgaaaagcaagttggaagccactgcttttaaagaaaagttttgcttggtttaggtttttccaattttatttttgttaggagccaggggataagatttattttaaatgaaaatcctcttcctaggttaagccattttttttatgcttaccaaatgtgccttggttagggttagtggagctttattagtcactatttgaataactggaaatcactgccatttccaggagatcacctatcctagttttgaggaatagtcattgaggtgggtttccttaatggcatctcttctagtaggcagatctgtttgaacaagataaatcctaaagagccagcctgcttgaggagtagacttggtgggtgaagccagcaattccgcacaaacgtcatgttgaattgttttgggctgcccaaaaacaacaggatgcagcatcctggctgtggcctggccctttgtggcagcagtggcatggacaagcaactgctaattcgagacttactattggcttcacagcacaccctacagtgagcagggtgatgagaccgtggaacagctacctgcttttggttaagattgccagatatcattaggacacagtagcagcaagaatgctgattttgtagtgttagaaaatgaactcagcttgtttttcctaattttgaaggtggtatatatctgcaaacatttaaaatggtataatatcatataaaatgtcaaaattagcacagtccctggatctcaaagaataggtaatattgacttggatgttctttatgctctctgaagaaaggtctagggaaagttcttgtttgcttgattgatcaagagtgccacggaagaatgtgagcgctgtggagggtggaggagggtgtcacttcagatggggcaggcacagggggagaaaagaagagaaaaacacacctgtgtgcaaaatgagctatttggtttcagtgcggcctgaccgatggggaggacccatgagcagagagagttctaggtcaacattgtaactccattgtcctccttcacccataagtcagtcctccttcctcattacagtgaaaccaacaatatgcagaggttggggagagatgcctgttcttcccccagcttcatataattgtcaaagttccaaaaatgaattatctgaactgcttaaaactggaaattaaaatctagacaagaatatgtctttcaagagctttttatgttttgaaagttcataaacctaagattggctccatctgagataaattttcttttctttttttttttgagacggagtctcgttctgtctcccaggctggagtgcagtggcatgatctcggctcactgcaacctccacctcctaggttcaagtgattctcctgagtagctggggttatagctacccaccaccacacccagctaatttttgtatttttagtagaggcaggttttcaccatgttggctaggctggtcttgaactcccgacctcaagtgatccacctgccttggcctcccaaagtgctgggattataggtgtgagcccccgtgcctggcccacaataaattttcatttcagagaaggaaaaaaatctcttgaacgtccagaaatgatttctggaatcagaatttcaatatgtaataccctcaggtaggcaatcttgaaccctctatgcagtgagagcattattaatatgagatgttgaatgatgcctttacagacttcagcagcaaagccatttggttgaggttttctgtgttaatgtgaaaagctaagccactgagatttgcaggggagcttctgagccaccctgcttgttggttatatgaggatgtaaaataggtggaattaaaatgtgagcaggaaaggcaaggcatgtgtgcattttcactcattttggtcaaggttaaactgacatgtatagcactgaggtctgtagggttcttaatatcttttgagtcttgctgtgaaatgaaagtgtgggaggtttcctttgtccattagcagccccaagaaccagaacccttttgctgcttttcttacatacctaacagctctccagtcatgatgaccaaggttgttcttcaatcaaatgtgtttgtgggattttcagtccgcaaatgaagtgctctctaatgaatgggacaccatgataaatatgtatttatatttagatgccaaagtatggcaaattatttccaaatgataactacaaatgggaattttcgatattctaccttttttatagaaccagctcacttttcatttctttttcattttgaattaagaaaattgttgaggatgtggtgggttccagtgtgtggaatggaaaggaaactgcagaatagtgtctgctccccattcagagggactgcttcctgtgccccccagacccggggcttcgacagcttctccacattccacacagatgcctaggagcagcgagttggtatatgaaaagtctcccaccttttctcctaaaacttctctcctttctctccataaaaagaaaaggaaaggaacaaaagaaaaacattcagtttttctttttctgaaaaaggtaagtcctttcctgaagtcatcaaatgaaacattatctggaaattagtttctaatgttgtatatgaagaaatacttaaatataagttcctgcagtatttattagatagttgtaactgtaaactcacctccctagtagataagagtttcaggttaaatactggaacatatataggcagtcaaaaatactactttaaatgtcattcacctattttaaagccatgttttagcactttttaggccaaagaaggtctgatagtgcctgtttttatgttctgtactctcacaaactttgttactcaaaattattgcatggcaggagagattggattatttatttcttatatttttataagtaaaaaaatctttctaaacaacaaatacctaacattattactgattgttttcctaatttatcctcctaagttgaatggtaacaaagcttttccagctgaatgaatgcacttagctgataaaccagaatttgttcttttttttccttctttttttttggagacaggttctcactctgtcaccgaggttggagtgcagtggtatgatcatagctgactgcagcctcaaccttctgggctcaaatgatcctttcacctcagcctcctgagtagctgggaccacaggtgtgtgccaccacacctggctaatttttatggatttttttttcttttttttttttcgccatgttgcccaggctggtcttgaactcttggcactcaagcagtccttctgcctcagcctcccaaagtgctgggattacagatgtgagccactgcacctggccccagaaattatgcttaaaaaaaaaattaagctgtgtggaatctggacaaggctatgtttctcctagaaacaggttttgctgtaaatggttttgatgggcgaaagtgtgagaaaaggttataatagattcttttttttaattttgtgagaaattccaggtcttcttgcttaacttatatgcatgtggatatatttgttttcaaagccatggaagaatctctgttcatatattttaatgcaaattaccttgtatgctgctatgcaaattctattaaaaggcctacctgcttaagaattaaacatttttgaaactttcagggaagacctgtagactcaagcactttctctgcttttttgtatcttatcttggacacttatgctgaattatgttcttattattttcactggttataagctattccttgtacataatatttaaactatccaaatatccagcatacatttccatgtggctgccatcggctgttgatgccatgaatgaaatggctggttagaaagccaaaggtcttcttttttcaattcctaatgaataagtaaaatgccagatctctttggtctcaaagcaaattgctctgatcagatcaaatatctatgtaatgaaaagagacttacttaaatttgggattctgcttaaactttaagttgaatttgactgtagtcattcattctttttatatatctctgtcaggtatgacattaattaccaggtggtattatactctactttgagtttggacatcactttcagttaaatttctgttgttattgtggcttttttttttttttaaccccactgaagatggaagtagagcagtctgccatctcctgctgttctttctctgtgccccctaattgcttggtaatctaaaattattctgactttccacatactgtctttaaaaaccaattgtagcaatctgcccgcctccaccctttaagctaaatctttcactgtgctggatacatagacactcgataaatgtgtgatgatagttctaaaataattatgctatatatcagggttctgtatttttgagcaatatcattattcctatgctgtgatgttaaatggaatttattttacactagtaatagactgcttaagtggctgatttgaaacctttctctaaaaaaacaaaaacatctggcagatgagtgacacaaattcattctcttaaaggatagaatttcaagttaaggataaggcacaataaataggcacatagaggacatctgtttttgtttttggtttgggttttgtttttttttggtctctctgactagctaaactgccaactagaagaatggttgttatgtagtaactcagaagaatcttttaataagtttcttctttggtttcaaaacaaacttgagcttcatttcttgccacctctattctttcttcccacgttgggtgactgaactgatgcttattctagttttagaagaggatccacatttaatgtaaggcataaatatgccttttgcaaattattgcttgttctccagtgaacatttgatcatattcaacagaaatccaccatataaaccataatccttgaattgccccttttaaaatagattggttaaaaccaaaaacctataagagagaaatgatatttcattgtattgtaggtttgggaatcctggttagatttataatttctggccgggtgcggtggctcatgcctgtattcccagtactttgggagcccaaggtgggtggatcacctgaggtaaggagtttgagaccagcctggccaacatggtgaaaccccatctctactaaaaatacaaaaagttagctgggcatggtggtgcgcgcctgtggtcccagctactcgggaggctgaggtgggagaatcccttgaacccaggaggcagaagttgcagtgagctgagatcatgccattgcactccagcctgggcaacagagcgagacttcatctccaaaaaaagaaaaagaagaaaaagatttataatttctgagtcccctaagtccctttctcagtttgcaataatcttacgtccatgctattgacactaattttgaaactggaaagctaattaatgacatattcatgtgttctttcatctaataaacatttattaatgtatagttctacaccaggcattctgaagggtccaaaagaaagttcctgccctctagtagcacataatccgttatttctcagcacaccatgccatctgtttatcattcagcagttaagtaattcatcacttcatatttttaccaaagtatatttacaagtctgtttatctggatctggcaaactggaaaatgtttgaagggatactcaggctttgatccatgccaacatgaaaggactccaagcacatttaagtaggctggtcttttcatcatgcatgattttttttttagtgcaaatttagactttagtttgggaaagagaacagtatacagtatcctttgtaagataaatcacaacaacaaaaattaagttttattgcacaaagtagataaatgagaaagtctttcttaaaaaatgcttctttaactgtaacagcaaaactaaatgcatattttatcaaccccttatttctaattgctgtattcatttccacccttaaactatttaagcatttcatctgctgaaagtccttatatacatggtagacggaatatttctccattaatgatagatcaaaatgaagatatttaaaaattaacaaaatcaggccaaggcaggaggatcactttagcccaggaggtccagaccagcctgggcaacacagcgggaccccgactccatttaaaaaattaaaaaaaaaaaaaaaacttttaacatttaaaaaataaaaattaacaaaatttcacttattccaggacacgctggcatttggactcaatgaaaagggcacctaaagaaaataaggctgactgaatgttttccataattttcacacaataacagtccctttctatccagcttgccttccatttatctctagggttagcttttcaggcaacatccttggtcattgcccagaaagtacctgagctatcagtgattggaatggcacaggaaaccgaatcacatgggtgccctccccttggttttcaagtatcttggagttgtgcacaaaaattaggtcatgccttcagtgtcttgttctttaaacctaccctttgacaatcaggtgctaatgattgtatactattaaaaccagcacataagtattgtaaatgtgtgttcctcctaggttggaagaaatgtctttccttctatctgggtcctgttaaagcgggtgtcagttgtgtcttttcacctcgatttgtgaattaatagaattggggggagaggaaatgatgatgtcaattaagtttcaggtttggcatgatcatcattctcgatgatattctcactttgtcgcaaatctgcccttatcgtaagaacaagtttcagaattttccctccactatacgactccagtattatgtttacaatccattggatgagtgcagcattataagaccttggtgcccagaaaaatctgtcctttttggtaccaaacctgaggtcttttggaagataatgtagaaaaccactacctattgaaggcctgttttggctaatctgtgcaaactctgatgatacctgcttatgtggattcttttccacactgctttcatttttaagtataaagacttagaaaactagaataatgcttttacaaataattaaaagtatgtgatgttctgggttttttccttctttttagaaccctgtatttaaacaagccttctttttaagtcttgtttgaaatttaagtctcagatcttctggataccaaatcaaaaacccaacgcgtaaaacagggcagtatttgtgttcctaattttaaaaagctttatgtatactctataaatatagatgcataaacaacacttccccttgagtagcacatcaacatacagcattgtacattacaatgaaaatgtgtaacttaagggtattatatatataaatacatatatacctttgtaacctttatactgtaaataaaaaagttgctttagtcacgtgggttgttt

SEQ ID NO: 312400 - DNA, 4122 bp, Homo sapiens
acccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcctcctctcccctgctaagctccaggtcctgagattgaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcata

SEQ ID NO: 312401 - DNA, 3378 bp, Homo sapiens
acccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcctcctctcccctgctaagctccaggtcctgagattgaattaggggctggagctcactgcactccagcagtcatgggacccaggataggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaac

SEQ ID NO: 312402 - DNA, 675 bp, Homo sapiens
  misc_feature (21)..(21): n is a, c, g, or t
  misc_feature (31)..(31): n is a, c, g, or t
agcccacaaggcccccacacnggtaggcacncaggcggctaataaatatgtttttattggtctttgcagtctcacgtcacaaaatagcagaatgaacacaaggcagatagagctggttggggagcacagacatgtggtggcctgaaagcagcttttccccttaagtctctagaacctgccatgagtaattaagacagtctttgaggatggggctgtcaggtgggggcgtttcagcaggtgccgacgagcgccttacaaacgactggctgctcgtgccgaattcggcacgagcctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacaatatgaggcttttaggatgtttatattccttcatccctcttgtttcccaggttttgcagggaaaaaaagtctggaattatagatacagcttattattaaatttgttcttgcata

SEQ ID NO: 312403 - DNA, 4416 bp, Homo sapiens
acccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcctcctctcccctgctaagctccaggtcctgagattgaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataatgtctcttctattacaaaaattctttcttcataaactgcattagaggtttgcaacaaccacatcatttccattaacttagatttaggttttactggattcattgctcaccattattgcttgtatattacatcttttccaatctttaaaaaagtctaatttttgtttgagtgtcttcgtctactaatggtttcaaaaatggaataaggtcatgaggatttctgaatcctcacctgtccaaattgtcattcacattttatagaagaggaaactggctcagaaagcacaagtgact

SEQ ID NO: 312404 - DNA, 4322 bp, Homo sapiens
cagacacctgagttattagtgacagacatggaggcagaagagttaaactctgctagatttcagctgtgctcaggccataatagtttttatgttctgacccatccctgctgtggctcacctgctgctgtctccaggagcccctgagaagatttgcctcctctcccctgctaagctccaggtcctgagattgaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataatgtctcttctattacaaaaattctttcttcataaactgcattagaggtttgcaacaaccacatcatttccattaacttagatttaggttttactggattcattgctcaccattattgcttgtatattacatcttttccaatctttaaaaaagtctaatttttgtttgagtgtcttcgtctactaatggtttcaaaaatggaataaggtcatgaggatttctgaatcctcacctgtccaaattgtcattcacattttatagaagaggaaactggctcagaaagcacaagtgact

SEQ ID NO: 312405 - DNA, 4104 bp, Homo sapiens
acccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcctcctctcccctgctaagctccaggtcctgagattgaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcata

SEQ ID NO: 312406 - DNA, 1546 bp, Homo sapiens
tggggaggagagctgagtgtaccctgaccgcacagatggtcatagctgaacgagcctgaaggctggcaagttcattcctacctgacaggagatggctaaggctcaaagaaggtgatccaggcgagtgcagacctgggctggggcccagcatggagggcagcctggcccactatggctcactgtgctatcctgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaagaatttcaaagtctccttcaacaatatgaggcttttaggatgtttatattccttcatccctcttgtttcccaggttttgcagggaaaaaaagtctggaattatagatacagcttattattaaatttgttcttgcataatgtctcttctattacaaaaattctttcttcataaactgcattagaggtttgcaacaaccacatcatttccattaacttagatttaggttttactggattcattgctcaccattattgcttgtatattacatcttttccaatctttaaaaaagtctaatttttgtttgagtgtcttcgtctactaatggtttcaaaaatggaataaggtcatgaggatttctgaatcctcacctgtccaaattgtcattcacattttatagaagaggaaactggctcagaaagcacaagtgact

SEQ ID NO: 312407 - DNA, 2584 bp, Homo sapiens
acccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcctcctctcccctgctaagctccaggtcctgagattgaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggc

SEQ ID NO: 312408 - DNA, 582 bp, Homo sapiens
ggagagaagggcataataagaacccttcaacgttgatgcatggcccttgggggctggaacccctccaacctcatgttgcccatgtctctgcttgttagaggagtgaagaaagaagacaagactttggctgtgggcatccagttcatgttcctgaggattttgggtaaagatcttgcttgggaccattggtggtggtgatggggtccagatgcccactgtgtgccaggcctggggcacaggcatgagcggaattcaatccctgatcttagggctcacaagctcatggggtgacagacctggcccagctctcctagagcggggtatagaggcagagtctagacagcccgtcaggaagccacctcggatgcaggggtggggcgggcttgagggccagacagccaagaggccccagtaacccagagcccctgaggggttgtacatgccagggagggggcagggtaggacggtgggccttcattgtcccctgagcaccacctccctcagcctggatgcccagccccgtgatccacggcagcgccatcgacaccacctgtgtgcactgggccctgagctgtgggcgtc

SEQ ID NO: 312409 - DNA, 1066 bp, Homo sapiens
acccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcctcctctcccctgctaagctccaggtcctgagattgaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagcaccttggacagcgcccaacccattacaggacgcggagccagcggaagccaagctctccacctcccttagcctctgggtgatggatttcctctcttctcaatttgattaaagcccagtagataacc

SEQ ID NO: 312410 - DNA, 2355 bp, Homo sapiens
  misc_feature (41)..(41): n is a, c, g, or t
ggataaagtactcccaggaaggctttgagccttggcagaanaggctgggattgaagcttcagggagagccagaggtgaggctggagtgggagatcacctgaggcagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggc

SEQ ID NO: 312411 - DNA, 4393 bp, Homo sapiens
acccagccttctatacaaccgtggagccagggcaagggagagacagaaggagcaagtgacccagggagacaaacacttggagatacttggggctgagtttgagcaagactccctaacctgtgtctggacaagtctgatgtcctgtgtggcccaagaagaactgaccccgtgtctggagctcccaccgttattgcatccctgctgtggctcacctgctgctgtctccaggagcccctgagaagatttgcctcctctcccctgctaagctccaggtcctgagattgaattaggggctggagctcactgcactccagcagtcatgggacccaggatagggccagcgggtgaggtaccccaggtaccagacaaggaaaccaaagccacaatgggcacagaaaacacacctggaggcaaagccagcccagaccctcaggacgtgcggccaagtgtgttccataacatcaagctgttcgttctgtgccacagcctgctgcagctggcgcagctcatgatctccggctacctaaagagctccatctccacagtggagaagcgcttcggcctctccagccagacgtcggggctgctggcctccttcaacgaggtggggaacacagccttgattgtgtttgtgagctattttggcagccgggtgcaccgaccccgaatgattggctatggggctatccttgtggccctggcgggcctgctcatgactctcccgcacttcatctcggagccataccgctacgacaacaccagccctgaggatatgccacaggacttcaaggcttccctgtgcctgcccacaacctcggccccagcctcggccccctccaatggcaactgctcaagctacacagaaacccagcatctgagtgtggtggggatcatgttcgtggcacagaccctgctgggcgtgggcggggtgcccattcagccctttggcatctcctacatcgatgactttgcccacaacagcaactcgcccctctacctcgggatcctgtttgcagtgaccatgatggggccaggcctggcctttgggctgggcagcctcatgctgcgcctttatgtggacattaaccagatgccagaaggtggtatcagcctgaccataaaggacccccgatgggtgggtgcctggtggctgggtttcctcatcgctgccggtgcagtggccctggctgccatcccctacttcttcttccccaaggaaatgcccaaggaaaaacgtgagcttcagtttcggcgaaaggtcttagcagtcacagactcacctgccaggaagggcaaggactctccctctaagcagagccctggggagtccacgaagaagcaggatggcctagtccagattgcaccaaacctgactgtgatccagttcattaaagtcttccccagggtgctgctgcagaccctacgccaccccatcttcctgctggtggtcctgtcccaggtatgcttgtcatccatggctgcgggcatggccaccttcctgcccaagttcctggagcgccagttttccatcacagcctcctacgccaacctgctcatcggctgcctctccttcccttcggtcatcgtgggcatcgtggtgggtggcgtcctggtcaagcggctccacctgggccctgtgggatgcggtgccctttgcctgctggggatgctgctgtgcctcttcttcagcctgccgctcttctttatcggctgctccagccaccagattgcgggcatcacacaccagaccagtgcccaccctgggctggagctgtctccaagctgcatggaggcctgctcctgcccattggacggctttaaccctgtctgcgaccccagcactcgtgtggaatacatcacaccctgccacgcaggctgctcaagctgggtggtccaggatgctctggacaacagccaggttttctacaccaactgcagctgcgtggtggagggcaaccccgtgctggcaggatcctgcgactcaacgtgcagccatctggtggtgcccttcctgctcctggtcagcctgggctcggccctggcctgtctcacccacacaccctccttcatgctcatcctaagaggagtgaagaaagaagacaagactttggctgtgggcatccagttcatgttcctgaggattttggcctggatgcccagccccgtgatccacggcagcgccatcgacaccacctgtgtgcactgggccctgagctgtgggcgtcgagctgtctgtcgctactacaataatgacctgctccgaaaccggttcatcggcctccagttcttcttcaaaacaggttctgtgatctgcttcgccttagttttggctgtcctgaggcagcaggacaaagaggcaaggaccaaagagagcagatccagccctgccgtagagcagcaattgctagtgtcggggccagggaagaagccagaggattcccgagtgtgagctgtcttggggccccacctggccaagagtagcagccacagcagtacctcctctgagtcctttgcccaagattgggtgtcaagagccctgtgttccattctggctcctccactaaattgctgtgtgacttcaggcaagacattgatcctctctcagcctttgcttgctagtctgaaccaaagagttgtttgggcatttgctgtgttggccatttctggagcaagagggtcttcttcctccttcccccagccagccagctgtcctggggccaggctttcctgggtggaaagaagtatacctttccctggggccctaggatagcaaagtgagccatagtgggccaggctgccctccatgctgggccccagcccaggtctgcactcgcctggatcaccttctttgagccttagccatctcctgtcaggtaggaatgaacttgccagccttcaggctcgttcagctatgaccatctgtgcggtcagggtacactcagctctcctccccaactccagcagcctttaagaagtgtccctttggcgccccctggaggcagagcactgagctggaccctgggtagactcccacagggaggacggagctggcctcaggagtgggacacccagacttggcagggccttcaagaggcctgtgtgggggccccaggaatccttagctgaagcggggagactcactctccatctcaggaaattctagcccttgccctcagggagccacggttgagggtgaggcccaacacctgccttagggccctgggtgggcaagtctgggccctggggtagggagggagactcaggcccacacttgggtattttctaatttcagacaaacacacactcagcgcgcactcactgattcctacacattgccaagatttcacacatgtgaccaggggccaccaaagtccctgtgacctttgtgactaggatcctaatttctctattttctcctgggtgcctgggtctgtgtcacctggggcagtgtggataatgtttagttctgtgacactgttttttgggggtggcacctggttctccgatgcctgggctggtgtcaggcccaggactgtagtgctgggagcagtaaagctcagctctgtgtaatgagtgatgctatggcttgctcgtgtcttatgatccaatccttttctacatcagcccttgttttgttttatggctagtcttatctggcctggttatttccttgcggggaggagagggtttgctaatctgctcccagcccaacctattaccaccccacctcgctgggacctactgctcgggaggcagcagacagggagccaccagcagtggcttcctggccctgtgctgggggtggggggaagctgggggcacatgtggcccttgccttctgagcagctcccagtgccagggctttgagactttcccacatgataaaagaaaagggaggtacagaagttccaattccctttttattttgctggttggtatctgtaaatgtttaataaatatctgagcatgtatctatcaacgccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaccatttggcccgcttggcccaagtcaattttaaactggacaaagtttatccatgcgcccgaaattggagctaattggccaaattccccttatagggagccgattaaaaatcaatggcccgtgttttaaaaacgtcggaattggaaaacccttggggtacccaaattaaatccctttgaagaaaatccccttttccccagttggcgaaataccaaaaagccccgaaccaatcgcctttccaaaaatttgccaaccctaaaggccaatggaaaattgaaagcgtaaaaatttggtaaaaatccccgtaaaatttttgg

SEQ ID NO: 312412 - DNA, 1970 bp, Homo sapiens
tgcgccatttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctcaaaaaaaaaaaaaaaaaaaaagaaaaaaacaaagatgaaagaaacaaacacaaaacataaagaaaaaaacgcaaaaaccagaaaacacaaaaaagagggggggcgcagaaacaaaaacaccgcggggggcaccccaaatgaccacacacagacttgatacgacagggggccacaaaaaagcgggagggacatataaaagaaccgaggcacgagcggcgcgaccgataccaaacagcgcgtgcgcagcgagaacaacagtgcgaaacaaggagagattgaagagaaagaagacgaccaacacacggggaggggaacacacacaaggggcgcacaagcccgcagaagggagaaacaaacggccccccgagggaggaagaaaaataacaaaagagagtggaagagcaggaggggaagaacaaaaaacgacagatagtacgggcgcgaggagagagaagacgagcgcccaagggcagcagactagaagcgggaacattaaacgccgaggggggaacgaaagaaagggggcggcggc

SEQ ID NO: 312413 - DNA, 2102 bp, Homo sapiens
tgcgccatttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatggtcagcagtcatttggaaagagcttgctctgccgccggccatagttgttgccggttcacctccccacccctctcccatcatcccctgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctcaaaaaaaaaaaaaaaaaaaaagaaaaaaacaaagatgaaagaaacaaacacaaaacataaagaaaaaaacgcaaaaaccagaaaacacaaaaaagagggggggcgcagaaacaaaaacaccgcggggggcaccccaaatgaccacacacagacttgatacgacagggggccacaaaaaagcgggagggacatataaaagaaccgaggcacgagcggcgcgaccgataccaaacagcgcgtgcgcagcgagaacaacagtgcgaaacaaggagagattgaagagaaagaagacgaccaacacacggggaggggaacacacacaaggggcgcacaagcccgcagaagggagaaacaaacggccccccgagggaggaagaaaaataacaaaagagagtggaagagcaggaggggaagaacaaaaaacgacagatagtacgggcgcgaggagagagaagacgagcgcccaagggcagcagactagaagcgggaacattaaacgccgaggggggaacgaaagaaagggggcggcggc

SEQ ID NO: 312414 - DNA, 358 bp, Homo sapiens
aggacgagtggcaggaagtcatggggaggtttgaaggtgagaagtccactgctatccacagctgcccttccccactggctgctttccatctgcatgaatgcgtcacactaggctcctctgccccctcctctgtgcttccctgcttcttggggcccatcaccttctcacagcctctctccaactacccccatcccaccctcccaaacaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagct

SEQ ID NO: 312415 - DNA, 2015 bp, Homo sapiens
tgcgccatttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgatgcctcccatgaaacccaggaacctgagtccttctcagcctggtcagatcgcctggcccgggaacatgcccagaagtgccagcagcagcagcgagaagcagagggatcctgtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctcaaaaaaaaaaaaaaaaaaaaagaaaaaaacaaagatgaaagaaacaaacacaaaacataaagaaaaaaacgcaaaaaccagaaaacacaaaaaagagggggggcgcagaaacaaaaacaccgcggggggcaccccaaatgaccacacacagacttgatacgacagggggccacaaaaaagcgggagggacatataaaagaaccgaggcacgagcggcgcgaccgataccaaacagcgcgtgcgcagcgagaacaacagtgcgaaacaaggagagattgaagagaaagaagacgaccaacacacggggaggggaacacacacaaggggcgcacaagcccgcagaagggagaaacaaacggccccccgagggaggaagaaaaataacaaaagagagtggaagagcaggaggggaagaacaaaaaacgacagatagtacgggcgcgaggagagagaagacgagcgcccaagggcagcagactagaagcgggaacattaaacgccgaggggggaacgaaagaaagggggcggcggc

SEQ ID NO: 312416 - DNA, 533 bp, Homo sapiens
  misc_feature (521)..(521): n is a, c, g, or t
tgcgccatttcctccagcctggagtgtctccgcccttcccgcctcccgtctccgagcttcttaaacacaggccttgggcctacggctctgggggtacttgggggggcgggggcaggtctgatgagtaacccctccccccaggttccagaggaagaagcctccacatctgtctgccggcccaagagttccatggcctccacttcccgccgccaacgccgagaacgtcgctttcgtcgttacttgtctgcaggacggctggtccgggcccaggccctcctccagcgacacccaggcctcgatgtagatgctgggcagcccccaccactgcaccgggcctgtgcccgccacgatgcccctgccctgtgcctgctgcttcggctcggggctgaccctgcccaccaggaccgccatggggacacggcactgcatgctgctgcccgccagggcccagatgcctacaccgatttcttcctcccgctgctaagccgctgtccctccgccatggagtaaatggcagggtngcgagctcgata

SEQ ID NO: 312417 - DNA, 364 bp, Homo sapiens
agtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagagtgagtaagatgagcacccggaggtgcctttgtggcttggggtatatgacttagggcatgtggcatcccccctctgatcttagtctgtcctctgggcatcaagggagaggtatgtggtgatttctgccagcctgtgagtggtgaggcgggggctgggcctggggctccccaccccatttctgtgtc

SEQ ID NO: 312418 - DNA, 5417 bp, Homo sapiens
agtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggaccgccgggagagcctgcccacctccccaccctggacgccgggcgcgtcccggccccccagcagcctagacggctgggtgagcccgggcccgtgggagccaggtcgcgggagcagcatgagcagccccccgccgctgccgccgccaccgcccatgtctccctcgtggagcgagcgctcggtgtccccgctgcgacctgagaccgaggcgcggccccccagccgccagctgcaggcgcttctggcgcgaaacatcatcaatgcggcccggcgcaagagcgcctccccgcggtcggcgggcgccgagaacccgcggcccttctccccgccgagggcgccaccgcccccgcccccgcccccgcccccgcccccgcgcatgcgctcgccacagcccgcccgccccggctcggctgctgtgccgggggcagccttcgcgcccatcccgcggagcccgttgcccgccggtccttcgtcctgcaccagtccccggagcccgctgcccgcgcctcccaggcccttcctctaccgccgctcgcccacggactccgacgtgtccctcgactccgaggactccggggctaagtctccaggcatcctgggctacaatatctgtccccgcgggtggaatggcagccttcggctcaagcgtggcagcctccccgccgaggcctcctgcaccacctagagccccacccccgaccccaccccgggagggcagagccagaagaaggctcattagacctgggggacccaaagggtctggcctctttgggcagccccagagatgaggggtcagcagaggagagctctggggttggggatgggttagggacgcaagcttgagttctagcccttgctctcattcagctgttgtgtgaccctgggtaagacccttccttgtttgaccctcagctttcccatctgtttaatggtggctttggccaaggcaatccacaaacgtcaaaattccccttcccatcagtacacacaccgatgcacacacactctctctttctctctctctctctctcactcacacacacacacacacacacacacacacacacacactagttagtgccttggatgaggcggggcagtgtgtatatggacccctggacttgctaccttcagggttccatactcgtccctcccctcctggctctgctgtctggagtctggcaagcggggtgtgttcagaaggtcctaggcctgtgtcgcatgtccaggcactggcctgaccatccggctccctggcaccaagtcccaggcaggagcagctgttttccatcccttcccagacaagctctatttttatcacaatgacctttagagaggtctcccaggccagctcaaggtgtcccactatcccctctggagggaagaggcaggaaaattctccccgggtccctgtcatgctactttctccatcccagttcagactgtccaggacatcttatctgcagccataagagaattataaggcagtgatttcccttaggcccaggacttgggcctccagctcatctgttccttctgggcccattcatggcaggttctgggctcaaagctgaactggggagagaagagatacagagctaccatgtgactttacctgattgccctcagtttggggttgcttattgggaaagagagagacaaagagttacttgttacgggaaatatgaaaagcatggccaggatgcatagaggagattctagcaggggacaggattggctcagatgacccctgagggctcttccagtcttgaaatgcattccatgatattaggaagtcgggggtgggtggtggtggtgggctagttgggcttgaatttaggggccgatgagcttgggtacgtgagcagggtgttaagttagggtctgcctgtatttctggtccccttggaaatgtccccttcttcagtgtcagacctcagtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagagattgcctgtgtcctgcctcttgcctcttgtagaatgcagctctggccctcaataaatgcttcctgcaccaacactccctaacccattattttcaaccctccttccccccaaacccaccctacccctcccccctctgccaccccttccc

SEQ ID NO: 312419 - DNA, 4373 bp, Homo sapiens
tgggggtaaaaatgattatcataatttaatgagtcgaacccacccgtccggggacgcgtgggtttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggaccgccgggagagcctgcccacctccccaccctggacgccgggcgcgtcccggccccccagcagcctagacggctgggtgagcccgggcccgtgggagccaggtcgcgggagcagcatgagcagccccccgccgctgccgccgccaccgcccatgtctccctcgtggagcgagcgctcggtgtccccgctgcgacctgagaccgaggcgcggccccccagccgccagctgcaggcgcttctggcgcgaaacatcatcaatgcggcccggcgcaagagcgcctccccgcggtcggcgggcgccgagaacccgcggcccttctccccgccgagggcgccaccgcccccgcccccgcccccgcccccgcccccgcgcatgcgctcgccacagcccgcccgccccggctcggctgctgtgccgggggcagccttcgcgcccatcccgcggagcccgttgcccgccggtccttcgtcctgcaccagtccccggagcccgctgcccgcgcctcccaggcccttcctctaccgccgctcgcccacggactccgacgtgtccctcgactccgaggactccggggctaagtctccaggcatcctgggctacaatatctgtccccgcgggtggaatggcagccttcggctcaagcgtggcagcctccccgccgaggcctcctgcaccacctagagccccacccccgaccccaccccgggagggcagagccagaagaaggctcattagacctgggggacccaaagggtctggcctctttgggcagccccagagatgaggggtcagcagaggagagctctggggttggggatgggttagggacgcaagcttgagttctagcccttgctctcattcagctgttgtgtgaccctgggtaagacccttccttgtttgaccctcagctttcccatctgtttaatggtggctttggccaaggcaatccacaaacgtcaaaattccccttcccatcagtacacacaccgatgcacacacactctctctttctctctctctctctctcactcacacacacacacacacacacacacacacacacacactagttagtgccttggatgaggcggggcagtgtgtatatggacccctggacttgctaccttcagggttccatactcgtccctcccctcctggctctgctgtctggagtctggcaagcggggtgtgttcagaaggtcctaggcctgtgtcgcatgtccaggcactggcctgaccatccggctccctggcaccaagtcccaggcaggagcagctgttttccatcccttcccagacaagctctatttttatcacaatgacctttagagaggtctcccaggccagctcaaggtgtcccactatcccctctggagggaagaggcaggaaaattctccccgggtccctgtcatgctactttctccatcccagttcagactgtccaggacatcttatctgcagccataagagaattataaggcagtgatttcccttaggcccaggacttgggcctccagctcatctgttccttctgggcccattcatggcaggttctgggctcaaagctgaactggggagagaagagatacagagctaccatgtgactttacctgattgccctcagtttggggttgcttattgggaaagagagagacaaagagttacttgttacgggaaatatgaaaagcatggccaggatgcatagaggagattctagcaggggacaggattggctcagatgacccctgagggctcttccagtcttgaaatgcattccatgatattaggaagtcgggggtgggtggtggtggtgggctagttgggcttgaatttaggggccgatgagcttgggtacgtgagcagggtgttaagttagggtctgcctgtatttctggtccccttggaaatgtccccttcttcagtgtcagacctcagtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagagattgcctgtgtcctgcctcttgcctcttgtagaatgcagctctggccctcaataaatgcttcctgcattcttctgcctcctgtgtcattttcagctgtgtctgatgtccttcccttctccccaagcatggagcagtccatgggactctgggtggctgggaatatttgagacatatgggatgggagcttgggaagaagcagccatggggagagatgggaacaacggacaacttgaggccatagaagtacctggactgcagtcctggtcctgtcatggac

SEQ ID NO: 312420 - DNA, 4585 bp, Homo sapiens
agtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggtgtggaagccttccttctgcttcaagtaacgaaccccacgggggtcccactgccggtcaagttcccctccttgagggccagatggagagcagatgtggcaggaaatggcacagagctgagtgaggagaatggggagtccatggttcaaggtcagatgcggccaccagctggctttgtgaccttgggcgagtcgcctcccctctctgagctgaagccgcccctcccctactacaacaggggtcggactccatgtctgagcggggaggagggtcatggagagagaactgtctggcagccctgatgcggtagaggggcatcctctggcctttgtgagctgtagggatgcagagtctgatgccagcgtcttgctgggggagtggcctagaaggggatcctaacagggacttctggagcagacagagcctgccagtgcctgtggagtcagccagccgagggtctgcctcctcagctgccccaggggggcctccctcctgaggctcaagctcctggcgtctttcttcctgttgctggattctcacctccatgggcctgtctcttctgcctctgccttctggacaccgtttcctctccgctgcttcagagagctttgcctcgcctccgcctgcgctcccctccagggtccttctgctggctgcggactcggcccaccactgctgtctgacgcttttcttcctgccccctctgaggcctggctctgttttagggagatcactgggcccaggcctcagccccagttctacctggcttgctgtcaccgctctaggggtgggggacgtcccaggggatccccaggagaaggagagccctgtagggggctgtgcagatgtgggtgtgccacagggagggtggcccctagccatgtatccattggctgttttggcttcagattcaaccaagatctgcctgactaaaagaagccacctcagcgcagtggaacggggcccagggggaggcaggagaggagggttccggtcccatgtcaccttctcatttgctgtgtgactttggcccactcacattctctttgggcctcagttttatcatttatacaaggagggcttttctagctgtaacaatctgtgaggattgagaggataggctggtgctttgaagaaaggccttgtaagtgacaagacagtcccctgggaagaaagagaaaggaaatgggctattgccaaaggacaggtggcgttagatggctgtgagggtgacctggtgagggaagggttggaatgagctgctgcaggaggccaagggatgcctgggctgggctgggctgggctggcttaggctcaggattgcctggggacagtaggagcatggcaggagctggggcaggtgcatagcagtgcagtgggaagggacagaggagatcttagaattttgaggaaaatctgggacttgagacctggattctaacagaccaactgcatgtgtgtctgtaggtctcagtttccacattcatacagtgagggtgttaagtcaggtagctggagacttcccatcgcctctgacacttttggaggtgatatgatacagcccccgaccaaaccaggctttgtggggggtgagagaatacagacacaagtggcaggattcagatggaagcttcgcaaggctgggggccgaggaccacccacttctctttcccagccctagttctgggttccccagtggggcaaggggtggtggaggcagtgcccatgctgggctgagcctgcagtttttgtgagctctgggcttgtctccatgggaacaggggtgccttcttagtgagctcatttcacacagatcgagggggtatgcgtgggggagttgtgagtgagctcagctccttcaggcctggcctctcccagaacagagtgaagcccctgccctggacccctgctcccttctacccttgagggccaccaatggaagagcccgcccttcattctgcagctcctgcggccaggctgagctctgcccccaactttgttttctctcatgttctcaatacactctgcctcaaatccgtcttgcttc

SEQ ID NO: 312421 - DNA, 5294 bp, Homo sapiens
agtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggaccgccgggagagcctgcccacctccccaccctggacgccgggcgcgtcccggccccccagcagcctagacggctgggtgagcccgggcccgtgggagccaggtcgcgggagcagcatgagcagccccccgccgctgccgccgccaccgcccatgtctccctcgtggagcgagcgctcggtgtccccgctgcgacctgagaccgaggcgcggccccccagccgccagctgcaggcgcttctggcgcgaaacatcatcaatgcggcccggcgcaagagcgcctccccgcggtcggcgggcgccgagaacccgcggcccttctccccgccgagggcgccaccgcccccgcccccgcccccgcccccgcccccgcgcatgcgctcgccacagcccgcccgccccggctcggctgctgtgccgggggcagccttcgcgcccatcccgcggagcccgttgcccgccggtccttcgtcctgcaccagtccccggagcccgctgcccgcgcctcccaggcccttcctctaccgccgctcgcccacggactccgacgtgtccctcgactccgaggactccggggctaagtctccaggcatcctgggctacaatatctgtccccgcgggtggaatggcagccttcggctcaagcgtggcagcctccccgccgaggcctcctgcaccacctagagccccacccccgaccccaccccgggagggcagagccagaagaaggctcattagacctgggggacccaaagggtctggcctctttgggcagccccagagatgaggggtcagcagaggagagctctggggttggggatgggttagggacgcaagcttgagttctagcccttgctctcattcagctgttgtgtgaccctgggtaagacccttccttgtttgaccctcagctttcccatctgtttaatggtggctttggccaaggcaatccacaaacgtcaaaattccccttcccatcagtacacacaccgatgcacacacactctctctttctctctctctctctctcactcacacacacacacacacacacacacacacacacacactagttagtgccttggatgaggcggggcagtgtgtatatggacccctggacttgctaccttcagggttccatactcgtccctcccctcctggctctgctgtctggagtctggcaagcggggtgtgttcagaaggtcctaggcctgtgtcgcatgtccaggcactggcctgaccatccggctccctggcaccaagtcccaggcaggagcagctgttttccatcccttcccagacaagctctatttttatcacaatgacctttagagaggtctcccaggccagctcaaggtgtcccactatcccctctggagggaagaggcaggaaaattctccccgggtccctgtcatgctactttctccatcccagttcagactgtccaggacatcttatctgcagccataagagaattataaggcagtgatttcccttaggcccaggacttgggcctccagctcatctgttccttctgggcccattcatggcaggttctgggctcaaagctgaactggggagagaagagatacagagctaccatgtgactttacctgattgccctcagtttggggttgcttattgggaaagagagagacaaagagttacttgttacgggaaatatgaaaagcatggccaggatgcatagaggagattctagcaggggacaggattggctcagatgacccctgagggctcttccagtcttgaaatgcattccatgatattaggaagtcgggggtgggtggtggtggtgggctagttgggcttgaatttaggggccgatgagcttgggtacgtgagcagggtgttaagttagggtctgcctgtatttctggtccccttggaaatgtccccttcttcagtgtcagacctcagtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagttttccgcgcccactagttccgcgccc

SEQ ID NO: 312422 - DNA, 2021 bp, Homo sapiens
agtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctgcccccaactttgttttctctcatgttctcaatacactctgcctcaaatccgtcttgcttc

SEQ ID NO: 312423 - DNA, 350 bp, Homo sapiens
tttttttttgatttgaggcaaagtgtattgagaacatgagaaaaaacaaagttgggggcaaagctcaacctggccgcaggagctgcaaaatgaagggcgggctcttccattggtggccctcaggggtatgcgtgggggagttgtgagtgagctcagctccttcaggcctggcctctcccagaacagagtgaagcccctgccctggacccctgctcccttctacccttgagggccaccaatggaagagcccgcccttcattctgcagctcctgcggccaggctgagctctgcccccaactttgttttctctcatgttctcaatacactctgcctcaaatccgtcttgcttc

SEQ ID NO: 312424 - DNA, 5547 bp, Homo sapiens
agtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggaccgccgggagagcctgcccacctccccaccctggacgccgggcgcgtcccggccccccagcagcctagacggctgggtgagcccgggcccgtgggagccaggtcgcgggagcagcatgagcagccccccgccgctgccgccgccaccgcccatgtctccctcgtggagcgagcgctcggtgtccccgctgcgacctgagaccgaggcgcggccccccagccgccagctgcaggcgcttctggcgcgaaacatcatcaatgcggcccggcgcaagagcgcctccccgcggtcggcgggcgccgagaacccgcggcccttctccccgccgagggcgccaccgcccccgcccccgcccccgcccccgcccccgcgcatgcgctcgccacagcccgcccgccccggctcggctgctgtgccgggggcagccttcgcgcccatcccgcggagcccgttgcccgccggtccttcgtcctgcaccagtccccggagcccgctgcccgcgcctcccaggcccttcctctaccgccgctcgcccacggactccgacgtgtccctcgactccgaggactccggggctaagtctccaggcatcctgggctacaatatctgtccccgcgggtggaatggcagccttcggctcaagcgtggcagcctccccgccgaggcctcctgcaccacctagagccccacccccgaccccaccccgggagggcagagccagaagaaggctcattagacctgggggacccaaagggtctggcctctttgggcagccccagagatgaggggtcagcagaggagagctctggggttggggatgggttagggacgcaagcttgagttctagcccttgctctcattcagctgttgtgtgaccctgggtaagacccttccttgtttgaccctcagctttcccatctgtttaatggtggctttggccaaggcaatccacaaacgtcaaaattccccttcccatcagtacacacaccgatgcacacacactctctctttctctctctctctctctcactcacacacacacacacacacacacacacacacacacactagttagtgccttggatgaggcggggcagtgtgtatatggacccctggacttgctaccttcagggttccatactcgtccctcccctcctggctctgctgtctggagtctggcaagcggggtgtgttcagaaggtcctaggcctgtgtcgcatgtccaggcactggcctgaccatccggctccctggcaccaagtcccaggcaggagcagctgttttccatcccttcccagacaagctctatttttatcacaatgacctttagagaggtctcccaggccagctcaaggtgtcccactatcccctctggagggaagaggcaggaaaattctccccgggtccctgtcatgctactttctccatcccagttcagactgtccaggacatcttatctgcagccataagagaattataaggcagtgatttcccttaggcccaggacttgggcctccagctcatctgttccttctgggcccattcatggcaggttctgggctcaaagctgaactggggagagaagagatacagagctaccatgtgactttacctgattgccctcagtttggggttgcttattgggaaagagagagacaaagagttacttgttacgggaaatatgaaaagcatggccaggatgcatagaggagattctagcaggggacaggattggctcagatgacccctgagggctcttccagtcttgaaatgcattccatgatattaggaagtcgggggtgggtggtggtggtgggctagttgggcttgaatttaggggccgatgagcttgggtacgtgagcagggtgttaagttagggtctgcctgtatttctggtccccttggaaatgtccccttcttcagtgtcagacctcagtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagagattgcctgtgtcctgcctcttgcctcttgtagaatgcagctctggccctcaataaatgcttcctgcattcttctgcctcctgtgtcattttcagctgtgtctgatgtccttcccttctccccaagcatggagcagtccatgggactctgggtggctgggaatatttgagacatatgggatgggagcttgggaagaagcagccatggggagagatgggaacaacggacaacttgaggccatagaagtacctggactgcagtcctggtcctgtcatggac

SEQ ID NO: 312425 - DNA, 5830 bp, Homo sapiens
  misc_feature (5351)..(5351): n is a, c, g, or t
  misc_feature (5365)..(5365): n is a, c, g, or t
  misc_feature (5377)..(5377): n is a, c, g, or t
agtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggaccgccgggagagcctgcccacctccccaccctggacgccgggcgcgtcccggccccccagcagcctagacggctgggtgagcccgggcccgtgggagccaggtcgcgggagcagcatgagcagccccccgccgctgccgccgccaccgcccatgtctccctcgtggagcgagcgctcggtgtccccgctgcgacctgagaccgaggcgcggccccccagccgccagctgcaggcgcttctggcgcgaaacatcatcaatgcggcccggcgcaagagcgcctccccgcggtcggcgggcgccgagaacccgcggcccttctccccgccgagggcgccaccgcccccgcccccgcccccgcccccgcccccgcgcatgcgctcgccacagcccgcccgccccggctcggctgctgtgccgggggcagccttcgcgcccatcccgcggagcccgttgcccgccggtccttcgtcctgcaccagtccccggagcccgctgcccgcgcctcccaggcccttcctctaccgccgctcgcccacggactccgacgtgtccctcgactccgaggactccggggctaagtctccaggcatcctgggctacaatatctgtccccgcgggtggaatggcagccttcggctcaagcgtggcagcctccccgccgaggcctcctgcaccacctagagccccacccccgaccccaccccgggagggcagagccagaagaaggctcattagacctgggggacccaaagggtctggcctctttgggcagccccagagatgaggggtcagcagaggagagctctggggttggggatgggttagggacgcaagcttgagttctagcccttgctctcattcagctgttgtgtgaccctgggtaagacccttccttgtttgaccctcagctttcccatctgtttaatggtggctttggccaaggcaatccacaaacgtcaaaattccccttcccatcagtacacacaccgatgcacacacactctctctttctctctctctctctctcactcacacacacacacacacacacacacacacacacacactagttagtgccttggatgaggcggggcagtgtgtatatggacccctggacttgctaccttcagggttccatactcgtccctcccctcctggctctgctgtctggagtctggcaagcggggtgtgttcagaaggtcctaggcctgtgtcgcatgtccaggcactggcctgaccatccggctccctggcaccaagtcccaggcaggagcagctgttttccatcccttcccagacaagctctatttttatcacaatgacctttagagaggtctcccaggccagctcaaggtgtcccactatcccctctggagggaagaggcaggaaaattctccccgggtccctgtcatgctactttctccatcccagttcagactgtccaggacatcttatctgcagccataagagaattataaggcagtgatttcccttaggcccaggacttgggcctccagctcatctgttccttctgggcccattcatggcaggttctgggctcaaagctgaactggggagagaagagatacagagctaccatgtgactttacctgattgccctcagtttggggttgcttattgggaaagagagagacaaagagttacttgttacgggaaatatgaaaagcatggccaggatgcatagaggagattctagcaggggacaggattggctcagatgacccctgagggctcttccagtcttgaaatgcattccatgatattaggaagtcgggggtgggtggtggtggtgggctagttgggcttgaatttaggggccgatgagcttgggtacgtgagcagggtgttaagttagggtctgcctgtatttctggtccccttggaaatgtccccttcttcagtgtcagacctcagtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagagattgcctgtgtcctgcctcttgcctcttgtagaatgcagctctggccctcaataaatgcttcctgcaaaaaaaaaaaaaaanaaaaaaaaaaaaanaaaaaaaaaaanaaaaaaaaaaaaacaaaaaacaaaaaaaaagaaaaaaaaaaaaaaaaagagagagagggcgacgcaggacgcacaaaaaaaaaacacgagaggagagagcacgcaccacaggggaggaggggggcaccaccatctcgacaagcgagggcgcgcccacaacatacaaagcgcggccaagcactacaatataatacggacgaggagcggccgcagcccagcccccacaaaaaagacagagcaggggatgcgaaaaagatcgggaagcaacacacgcgcgccgcgcggcggcgcgcacaccactcggagcagaagcgacgccacccaccacaccgccgcgcgggcgggcggaccgacacacctagctggcggtgagaacaaacgagcaccgcacgaacccgacgaaagaatagtgggacgacctacgcagccgggagcgacgcagaacccaccacc

SEQ ID NO: 312426 - DNA, 5390 bp, Homo sapiens
aacgggctgatgcggttggagcgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggaccgccgggagagcctgcccacctccccaccctggacgccgggcgcgtcccggccccccagcagcctagacggctgggtgagcccgggcccgtgggagccaggtcgcgggagcagcatgagcagccccccgccgctgccgccgccaccgcccatgtctccctcgtggagcgagcgctcggtgtccccgctgcgacctgagaccgaggcgcggccccccagccgccagctgcaggcgcttctggcgcgaaacatcatcaatgcggcccggcgcaagagcgcctccccgcggtcggcgggcgccgagaacccgcggcccttctccccgccgagggcgccaccgcccccgcccccgcccccgcccccgcccccgcgcatgcgctcgccacagcccgcccgccccggctcggctgctgtgccgggggcagccttcgcgcccatcccgcggagcccgttgcccgccggtccttcgtcctgcaccagtccccggagcccgctgcccgcgcctcccaggcccttcctctaccgccgctcgcccacggactccgacgtgtccctcgactccgaggactccggggctaagtctccaggcatcctgggctacaatatctgtccccgcgggtggaatggcagccttcggctcaagcgtggcagcctccccgccgaggcctcctgcaccacctagagccccacccccgaccccaccccgggagggcagagccagaagaaggctcattagacctgggggacccaaagggtctggcctctttgggcagccccagagatgaggggtcagcagaggagagctctggggttggggatgggttagggacgcaagcttgagttctagcccttgctctcattcagctgttgtgtgaccctgggtaagacccttccttgtttgaccctcagctttcccatctgtttaatggtggctttggccaaggcaatccacaaacgtcaaaattccccttcccatcagtacacacaccgatgcacacacactctctctttctctctctctctctctcactcacacacacacacacacacacacacacacacacacactagttagtgccttggatgaggcggggcagtgtgtatatggacccctggacttgctaccttcagggttccatactcgtccctcccctcctggctctgctgtctggagtctggcaagcggggtgtgttcagaaggtcctaggcctgtgtcgcatgtccaggcactggcctgaccatccggctccctggcaccaagtcccaggcaggagcagctgttttccatcccttcccagacaagctctatttttatcacaatgacctttagagaggtctcccaggccagctcaaggtgtcccactatcccctctggagggaagaggcaggaaaattctccccgggtccctgtcatgctactttctccatcccagttcagactgtccaggacatcttatctgcagccataagagaattataaggcagtgatttcccttaggcccaggacttgggcctccagctcatctgttccttctgggcccattcatggcaggttctgggctcaaagctgaactggggagagaagagatacagagctaccatgtgactttacctgattgccctcagtttggggttgcttattgggaaagagagagacaaagagttacttgttacgggaaatatgaaaagcatggccaggatgcatagaggagattctagcaggggacaggattggctcagatgacccctgagggctcttccagtcttgaaatgcattccatgatattaggaagtcgggggtgggtggtggtggtgggctagttgggcttgaatttaggggccgatgagcttgggtacgtgagcagggtgttaagttagggtctgcctgtatttctggtccccttggaaatgtccccttcttcagtgtcagacctcagtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagagattgcctgtgtcctgcctcttgcctcttgtagaatgcagctctggccctcaataaatgcttcctgcattcttctgcctcctgtgtcattttcagctgtgtctgatgtccttcccttctccccaagcatggagcagtccatgggactctgggtggctgggaatatttgagacatatgggatgggagcttgggaagaagcagccatggggagagatgggaacaacggacaacttgaggccatagaagtacctggactgcagtcctggtcctgtcatggac

SEQ ID NO: 312427 - DNA, 5351 bp, Homo sapiens
agtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctgtcctgtatcccagctccgaccccaagtcttctcatctgaagggccaggcggttcctgccagcaagacgggcattctggaggagtcgatggcccgccggggcagccgcaaatccatgtttactttcgtggagaagcccaaggtgaccccgaatccagacttgctggatctggtacagacagcggatgagaagcggcggcagagggaccagggggaggtaggcgtggaggaggagcccttcgcactgggggccgaggcctccaacttccagcaggagccagcacctcgtgacagggccagccccgcggcggcggaggaggtggtaccagagtgggcctcctgcctcaagtcaccccgcatccaggccaagccgaagcccaaacccaaccagaacctctccgaggcctctgggaagggagctgagctctacgcccgccgccagtcacggatggagaaatatgtcatcgagtcttcaagccacacgccagagctggcccgctgcccatcacctaccatgtccctgccttcctcctggaaataccccactaacgcccccggggccttccgagtggcatcccgaagcccagcccggaccccgcctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggaccgccgggagagcctgcccacctccccaccctggacgccgggcgcgtcccggccccccagcagcctagacggctgggtgagcccgggcccgtgggagccaggtcgcgggagcagcatgagcagccccccgccgctgccgccgccaccgcccatgtctccctcgtggagcgagcgctcggtgtccccgctgcgacctgagaccgaggcgcggccccccagccgccagctgcaggcgcttctggcgcgaaacatcatcaatgcggcccggcgcaagagcgcctccccgcggtcggcgggcgccgagaacccgcggcccttctccccgccgagggcgccaccgcccccgcccccgcccccgcccccgcccccgcgcatgcgctcgccacagcccgcccgccccggctcggctgctgtgccgggggcagccttcgcgcccatcccgcggagcccgttgcccgccggtccttcgtcctgcaccagtccccggagcccgctgcccgcgcctcccaggcccttcctctaccgccgctcgcccacggactccgacgtgtccctcgactccgaggactccggggctaagtctccaggcatcctgggctacaatatctgtccccgcgggtggaatggcagccttcggctcaagcgtggcagcctccccgccgaggcctcctgcaccacctagagccccacccccgaccccaccccgggagggcagagccagaagaaggctcattagacctgggggacccaaagggtctggcctctttgggcagccccagagatgaggggtcagcagaggagagctctggggttggggatgggttagggacgcaagcttgagttctagcccttgctctcattcagctgttgtgtgaccctgggtaagacccttccttgtttgaccctcagctttcccatctgtttaatggtggctttggccaaggcaatccacaaacgtcaaaattccccttcccatcagtacacacaccgatgcacacacactctctctttctctctctctctctctcactcacacacacacacacacacacacacacacacacacactagttagtgccttggatgaggcggggcagtgtgtatatggacccctggacttgctaccttcagggttccatactcgtccctcccctcctggctctgctgtctggagtctggcaagcggggtgtgttcagaaggtcctaggcctgtgtcgcatgtccaggcactggcctgaccatccggctccctggcaccaagtcccaggcaggagcagctgttttccatcccttcccagacaagctctatttttatcacaatgacctttagagaggtctcccaggccagctcaaggtgtcccactatcccctctggagggaagaggcaggaaaattctccccgggtccctgtcatgctactttctccatcccagttcagactgtccaggacatcttatctgcagccataagagaattataaggcagtgatttcccttaggcccaggacttgggcctccagctcatctgttccttctgggcccattcatggcaggttctgggctcaaagctgaactggggagagaagagatacagagctaccatgtgactttacctgattgccctcagtttggggttgcttattgggaaagagagagacaaagagttacttgttacgggaaatatgaaaagcatggccaggatgcatagaggagattctagcaggggacaggattggctcagatgacccctgagggctcttccagtcttgaaatgcattccatgatattaggaagtcgggggtgggtggtggtggtgggctagttgggcttgaatttaggggccgatgagcttgggtacgtgagcagggtgttaagttagggtctgcctgtatttctggtccccttggaaatgtccccttcttcagtgtcagacctcagtcccagtgtccatatcgtgcccagaaaagtagacattatcctgccccatcccttccccagtgcactctgacctagctagtgcctggtgcccagtgacctgggggagcctggctgcaggccctcactggttccctaaaccttggtggctgtgattcaggtccccaggggggactcagggaggaatatggctgagttctgtagtttccagagttggctggtagagccttctagaggttcagaatattagcttcaggatcagctgggggtatggaattggctgaggatcaaacgtatgtaggtgaaaggataccaggatgttgctaaaggtgagggacagtttgggtttgggacttaccggggtgatgttagatctggaacccccaagtgaggctggagggagttaaggtcagtatggaagatagggttgggacagggtgctttggaatgaaagagtgaccttagagggctccttgggcctcaggaatgctcctgctgctgtgaagatgagaaggtgctcttactcagttaatgatgagtgactatatttaccaaagcccctacctgctgctgggtcccttgtagcacaggagactggggctaagggcccctcccagggaagggacaccatcaggcctctggctgaggcagtagcatagaggatccatttctacctgcatttcccagaggactagcaggaggcagccttgagaaaccggcagttcccaagccagcgcctggctgttctctcattgtcactgccctctccccaacctctcctctaacccactagagattgcctgtgtcctgcctcttgcctcttgtagaatgcagctctggcccacatcgaaggatcctctaatcaacctcaccaaca

SEQ ID NO: 312428 - DNA, 3987 bp, Homo sapiens
agtcatctgtggaggagaaaagtcacatccagctccttcatgttgctgccgatgtgggattttcctggcttcgtcagccaagcaattggctgcctttgccggaggctttgagaaccaaggcttgaaggccggcaggagcatccagggggaagcttggcttcagggaggacctagcagacgttgggccggagcactagcctcacggagaaggatctgaaagaagccaaggcgcggagccagcagattgcagcccagctgaccacccctcccagctccaattcccgtggcgtccagctcttcaacaggcgccggcagagggtgaacgagttcaccttggagagccacggccagaggggacagaagcccagccaggagtccctcagagtgctcccttcaagcctcccaggccatgcaccggggctcagcctgagttccacctcgctgccggagccaggccctccacggcaccccagtccccagagccccgacagaggggtccctggccacagcatggaggggtactcagaggaggctagcttgctgcggcacctggagaaggtggccagtgaggaggaagaggtaccactggtggtttatctaaaggagaatgcagcactgctgacagccaatgggctgcacctgtcccaaaaccgagaggcccagcagtcctcaccggccccacctccagctgaggtccacagcccagctgcagatgtcaaccaaaaccttgcctcgcccagtgccacgctcaccacaccaacttctaacagcagccacaatccgccagccaccgatgtcaatcagaacccaccggcaactgttgtcccacagagcctgccactttctagcatccaacagaattcctcagaggcccaactcccatctaatggcacagggcctgcttccaaacccagcaccctgtgtgctgatgggcaaccccaggcaccggctgaggaggtgagatgcagcacactcctaattgacaaggtatcaactccagctaccaccaccagcaccttctccagagaagctacgctcatccccagctccaggcccccagcctcagatttcatgtccagctccctgctcattgacatccagcccaacaccctagtggtgtcagcagatcaagagatgtctgggcgagcagctgccaccacgcccaccaaggtctacagtgaggtccacttcacactggccaagcccccatcagtggtcaacaggacggccaggccttttgggatccaggcgccagggggcaccagccagatggagaggagccccatgctagagagacgacattttggggagaaggccccggctccccagccccccagtttgccagacaggagcccccggccacagagacacataatgtcccgcagccccatggtggaaaggaggatgatggggcagcgaagcccggcctcagagagacgccccttggggaacttcactgcaccccccacctacactgagaccttgtccacagcccctctggcttcctgggtgaggtctcctccctcatattctctgcctccctctaccatggctacctgcctgagaacggggtcctgcgcccagagcccaccaagcagccgccataccagctgcgcccctcgctctttgtcctctcacctatcaaggagcctgccaaggtctcaccaagagctgcctcgcccgccaagcccagctccttggacctggtgcccaacctgcccaagggggctctccctccatctcctgccctgcctcggccctcgcgctcctcaccgggcctctacacctcccccggccaggacagcctgcagcccactgccgtgagccctccttacggcggtgacatctcccccgtgtctccctccagggcgtggtctccccgagccaagcaggcccccaggccctccttctctacccggaacgccgggatcgaggctcaggtgtggaagccttccttctgcttcaagtaacgaaccccacgggggtcccactgccggtcaagttcccctccttgagggccagatggagagcagatgtggcaggaaatggcacagagctgagtgaggagaatggggagtccatggttcaaggtcagatgcggccaccagctggctttgtgaccttgggcgagtcgcctcccctctctgagctgaagccgcccctcccctactacaacaggggtcggactccatgtctgagcggggaggagggtcatggagagagaactgtctggcagccctgatgcggtagaggggcatcctctggcctttgtgagctgtagggatgcagagtctgatgccagcgtcttgctgggggagtggcctagaaggggatcctaacagggacttctggagcagacagagcctgccagtgcctgtggagtcagccagccgagggtctgcctcctcagctgccccaggggggcctccctcctgaggctcaagctcctggcgtctttcttcctgttgctggattctcacctccatgggcctgtctcttctgcctctgccttctggacaccgtttcctctccgctgcttcagagagctttgcctcgcctccgcctgcgctcccctccagggtccttctgctggctgcggactcggcccaccactgctgtctgacgcttttcttcctgccccctctgaggcctggctctgttttagggagatcactgggcccaggcctcagccccagttctacctggcttgctgtcaccgctctaggggtgggggacgtcccaggggatccccaggagaaggagagccctgtagggggctgtgcagatgtgggtgtgccacagggagggtggcccctagccatgtatccattggctgttttggcttcagattcaaccaagatctgcctgactaaaagaagccacctcagcgcagtggaacggggcccagggggaggcaggagaggagggttccggtcccatgtcaccttctcatttgctgtgtgactttggcccactcacattctctttgggcctcagttttatcatttatacaaggagggcttttctagctgtaacaatctgtgaggattgagaggataggctggtgctttgaagaaaggccttgtaagtgacaagacagtcccctgggaagaaagagaaaggaaatgggctattgccaaaggacaggtggcgttagatggctgtgagggtgacctggtgagggaagggttggaatgagctgctgcaggaggccaagggatgcctgggctgggctgggctgggctggcttaggctcaggattgcctggggacagtaggagcatggcaggagctggggcaggtgcatagcagtgcagtgggaagggacagaggagatcttagaattttgaggaaaatctgggacttgagacctggattctaacagaccaactgcatgtgtgtctgtaggtctcagtttccacattcatacagtgagggtgttaagtcaggtagctggagacttcccatcgcctctgacacttttggaggtgatatgatacagcccccgaccaaaccaggctttgtggggggtgagagaatacagacacaagtggcaggattcagatggaagcttcgcaaggctgggggccgaggaccacccacttctctttcccagccctagttctgggttccccagtggggcaaggggtggtggaggcagtgcccatgctgggctgagcctgcagtttttgtgagctctgggcttgtctccatgggaacaggggtgccttcttagtgagctcatttcacacagatcgagggggtatgcgtgggggagttgtgagtgagctcagctccttcaggcctggcctctcccagaacagagtgaagcccctgccctggacccctgctcccttctacccttgagggccaccaatggaagagcccgcccttcattctgcagctcctgcggccaggctgagctctgcccccaactttgttttctctcatgttctcaatacactctgcctcaaatccgtcttgcttc

SEQ ID NO: 312429 - DNA, 1250 bp, Homo sapiens
acccctgggcaggaccctagccctaagcacacaccaccctgtgctgcaaccatgagaaagtgcccatgccttgggctgtccagaagctcaggagtgatcagagggcaccttctctaagaggggaggttcctggctaagggaccatggagtggtgggcagcctgaaggggctgggcacagcccagctttgcgcacactcgcctggtcccatcattccctaccttggcttaaacctaggaggcctggattttgcagttagcctaatcttccagccccaggcgaggctccctggtgaggaatcagctgagccatcaccacgttttggggcctgtatcctcttccctgagccgctgacgcatccagggctctagtctgcacataaattccctctcagctgggcttgtaaaatcccttctcaccccagttagcaaaaatcaagggaagagcctagtttttttaaaagattcacttaatatccaccccccacctcaagcccaagaccgcccattcaaaaaacaagtatacggcacagcaagggagacccactagattttgagcttacagagacataagggtacttaaaaccctgccggcctagtatttgagcttagaacttttatttaaaatgagccggcagtctctagacacacaccgatcctcaggctagtccgagccctgaggtcaagaatgaaatgcacttcccttctcattttctcaaatagatcttttccagccgtctcacagttgaccccaactttggaactcagatcataggatctcccagaggtttcaggtgttcctaagaagcttctaaaggaagttttggaagaaagactaataggtgtaaacatataaacatatatattatatatagctatatatatttaaagagatctctacatatatatatatataaatacaactactgtactctctgcatctgtacaaagtatgagttaaactgcccaggtagtgtgagatacgtaatgcatgaatgtgaatatcctgaaatctgccttcttagcaacgtgccgcgtgtactggagagaggacagttgctcctgggagttctctcaatgggcaaatgtacaagttgatgccgtcttatccaccaacaagccattaaggttggtttcctgctgagacttttgtaccggaagcgagaccggcagcactgggggtgtccatatgccacttatgaggaagaaagcaccatgacttttttattttcaataaaaatatagagatgtc

SEQ ID NO: 312430 - DNA, 305 bp, Homo sapiens
caagtctgtctactttattgcagggcccagaggttcccccaagaccgcctgataataatttggtatttggaggctcctgtgtcactgcaggaactaaaatgttggaatttttactcttgatatccttccagatcaactctctcaatgttcccatcctcaaaactatcatctggggtaactgaggcagtcagagatttactgactcaatgtcactcagttgattctgagttcactgctgattacatctgaccaaactgctttttctgaagtctactctgtttcatcatgctggtgatgattttgtg

SEQ ID NO: 312431 - DNA, 7439 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatcccccaccccaccccacccaccctgttccttttttatcaggaggacttcagagccaggcctgcagcattttgtttgaaaacacaatcagctctgacagttagacatgcacacagacgccatagctggattggaaacattgatgttttaaaaatttatttttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtggggctgccagtttattacttttgtcttaaaacatgatcattgttctctcacggtatccttctgtcttcccgttggcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcgtaatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaaattttatttttagtgctgttttaacaatgtagatagatcataaatgtacttgctgaattcaatcatttttaacaagccaataaagtttgataattcat

SEQ ID NO: 312432 - DNA, 7442 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatcccccaccccaccccacccaccctgttccttttttatcaggaggacttcagagccaggcctgcagcattttgtttgaaaacacaatcagctctgacagttagacatgcacacagacgccatagctggattggaaacattgatgttttaaaaatttatttttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttatgccagtttattacttttgtcttaaaacatgatcattgttctctcacggtatccttctgtcttcccgttggcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcgtaatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaaattttatttttagtgctgttttaacaatgtagatagatcataaatgtacttgctgaattcaatcatttttaacaagccaataaagtttgataattcat

SEQ ID NO: 312433 - DNA, 7717 bp, Homo sapiens
  misc_feature (7717)..(7717): n is a, c, g, or t
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatcccccaccccaccccacccaccctgttccttttttatcaggaggacttcagagccaggcctgcagcattttgtttgaaaacacaatcagctctgacagttagacatgcacacagacgccatagctggattggaaacattgatgttttaaaaatttatttttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtggggctgccagtttattacttttgtcttaaaacatgatcattgttctctcacggtatccttctgtcttcccgttggcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcgtaatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaaattttatttttagtgctgttttaacaatgtagatagatcataaatgtacttgctgaattcaatcatttttaacaagccaataaagtttgataattcatattctttaatgaagatttgctatgaatttgtttactctttcataccaccttcagatagctagtcagttcagcaggagcagagaccaggttagcacgcggatggggtgtaattcagtgtttttgtgttgtacagcctgagaaatgccagtggcctgacagcagcagacattgcaccccagggtttccaagagtgtgcccagtttctcttgaacctccgn

SEQ ID NO: 312434 - DNA, 7442 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatcccccaccccaccccacccaccctgttccttttttatcaggaggacttcagagccaggcctgcagcattttgtttgaaaacacaatcagctctgacagttagacatgcacacagacgccatagctggattggaaacattgatgttttaaaaatttatttttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcctctttgtaaatcaacacctttgggaaagatcggaatctaagtaatgacagaaactgtcatttagccgcgaacaagaaaatgggaatcctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtggggctgccagtttattacttttgtcttaaaacatgatcattgttctctcacggtatccttctgtcttcccgttggcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcgtaatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaaattttatttttagtgctgttttaacaatgtagatagatcataaatgtacttgctgaattcaatcatttttaacaagccaataaagtttgataattcat

SEQ ID NO: 312435 - DNA, 7453 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgaggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatcccccaccccaccccacccaccctgttccttttttatcaggaggacttcagagccaggcctgcagcattttgtttgaaaacacaatcagctctgacagttagacatgcacacagacgccatagctggattggaaacattgatgttttaaaaatttatttttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtggggctgccagtttattacttttgtcttaaaacatgatcattgttctctcacggtatccttctgtcttcccgttggcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcgtaatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaaattttatttttagtgctgttttaacaatgtagatagatcataaatgtacttgctgaattcaatcatttttaacaagccaataaagtttgataattcat

SEQ ID NO: 312436 - DNA, 1864 bp, Homo sapiens
aaggtgtgatggatgtcagatgtttcctatcaatggatccagattcaaatgcagtaactgtgatgactttgatttttgtgaaacgtgtttcaagaccgtttttacactataccaggcatacatttggcagaataaatgaacctaggcttcagctagtaagtaacacttcctataagtctcgcccaactaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcgtaatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaaattttatttttagtgctgttttaacaatgtagatagatcataaatgtacttgctgaattcaatcatttttaacaagccaataaagtttgataattcat

SEQ ID NO: 312437 - DNA, 2695 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatggcccagaggttcccccaagaccgcctgataataatttggtatttggaggctcctgtgtcactgcaggaactaaaggaggctaaatccatgcctgatggaggagaagagttctatggttatctgcaaattctggccagacaacatcttgacgtcactccttagcttccataa

SEQ ID NO: 312438 - DNA, 333 bp, Homo sapiens
cgttttggtgtttacaacatttatttatttttaggatagcttgccctcccttttaggcagggtgggaaaggagaacgcggggagggagaagggagggaggattcctataataagaatcagcgcatttttcagagctgaaccaagcacggtttccatttcaaaaagggagacagcctctaccgcgattgtagaagagactgtggtgtgaattagggaccgggaggcgtcgaacggaggaacggttcatcttagaggtacctggatgtaaatgcacacacacacacagacacacacacgcacgcgcgtgcatgtctacacggccaggatgtgtgc

SEQ ID NO: 312439 - DNA, 7499 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatcccccaccccaccccacccaccctgttccttttttatcaggaggacttcagagccaggcctgcagcattttgtttgaaaacacaatcagctctgacagttagacatgcacacagacgccatagctggattggaaacattgatgttttaaaaatttatttttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtggggctgccagtttattacttttgtcttaaaacatgatcattgttctctcacggtatccttctgtcttcccgttggcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcgtaatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaaattttatttttagtgctgttttaacaatgtagatagatcataaatgtacttgctgaattcaatcatttttaacaagccaataaagtttgataattcat

SEQ ID NO: 312440 - DNA, 7445 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatcccccaccccaccccacccaccctgttccttttttatcaggaggacttcagagccaggcctgcagcattttgtttgaaaacacaatcagctctgacagttagacatgcacacagacgccatagctggattggaaacattgatgttttaaaaatttatttttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtggggctgccagtttattacttttgtcttaaaacatgatcattgttctctcacggtatccttctgtcttcccgttggcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagtctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaaattttatttttagtgctgttttaacaatgtagatagatcataaatgtacttgctgaattcaatcatttttaacaagccaataaagtttgataattcat

SEQ ID NO: 312441 - DNA, 4582 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttcttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggcttccgtgagacacaagatggcgcatagtgtgctcggacacagttttgtcttcgtaggttgtgatgatagcactggtttgtttctcaagcgctatccacagaacctttgtcaacttcagttgaaaagaggtggattcatgtccagagctcatttcggggtcaggtgggaaagccaagaacttggaaaagataagacaagctataaattcggaggcaagtttcttttacaatgaacttttcagatctcacttccctccgacccctaacttccatgcccacccgtccttttaa

SEQ ID NO: 312442 - DNA, 2360 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagcgttgctggaagggatcctctaacat

SEQ ID NO: 312443 - DNA, 1867 bp, Homo sapiens
atcccctacactgttgtcctactgcagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 312444 - DNA, 2008 bp, Homo sapiens
tgcgtttcgtagtttgagtttgtaggcagatagtaatgaggatgtgagtccgtgggcgattatgagaatgacgcgccggtgaagcttcagaggggtatggatgagaatggctgttactacgagggctatgtggctgattgaagagtatgcaatgagcgattttaggtctgtttgtcgtaggcagatggagcttgttataattatgcctcatagggatagtacaaggaaggggtaggctatgtgttttgtcagggggttgagaatgagtgtgaggcgtattataccatagccgcctagttttaagagtactgcggcaagtactattgacccagcgaaaacggcatcttcatcggccgatgaagatgccgttttcggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 312445 - DNA, 2023 bp, Homo sapiens
gctcaaatagctgggactacaggcaatgcaccaccataaccagcgaatttttaaaaattatttttgtagagacagggtctcactatgttgcccaaactagtcttgaagttctgacctcagccccgcaaagtgctaggattacaggcgtgagccactgcttctgcttgcattatctcaaatttttagagcctaacttcacagtcttgcctcggagcaggaactgtttgaggcaacaagatggagcctctggtttcttcactaggcagactgtgctcaaactgggtagcatgaaaggaaagcagcacaattaaaattgaaattgggggattctttcccctattgaaatccaaataattttcctttattgtgctttttttttttttctttaggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 312446 - DNA, 1116 bp, Homo sapiens
ggtggccacagtcgaaaaatcccaaggcccaaacctgcaccactgactgctgaaattcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 312447 - DNA, 979 bp, Homo sapiens
aggacccccatgcaataacctccgccctcattaggttgcgttttgtagcccgtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 312448 - DNA, 929 bp, Homo sapiens
atcccctacactgttgtcctactgcagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggatgtcactgattttatcagtcatttgttcatgcagctgggaactgtggggatatatgatttgccacatctgaggaacaaactggttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgattt

SEQ ID NO: 312449 - DNA, 1366 bp, Homo sapiens
atcccctacactgttgtcctactgcagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggccctaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattacccttactgtcaacccaacacaggcatgctcataaggaaaggttaaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaaatagggacctgtatgaatggctccacgagggttcagctgtctcttacttttaaccagtgaaattgacctgcccgtgaagagacgggcatgacacagcaagacgagaagaccctatggccgctttaatttattaatgcaaacagtacctaacaaacccacaggtcctaaactaccaaacctgcactaaaaatttcgtttgggtcgatcctcgagtatg

SEQ ID NO: 312450 - DNA, 935 bp, Homo sapiens
tgacattgtgccactgcatttcagcctgggtgacagagtgagactctgtctcaaaaacaaaacaaacagaaacaagaactctatgttgagaaatccatactagagggtttaatttctcactttgtgtgctagtgattaataaatttcaagcttatcacacagccagaaatgtcacctgtgtttctacaataaaagatttgggaatattgtgacattttttcactgagccttctgggttcattattaagatataacaattttagaagacttattgagataggtatactttttaaaatttggattcaatatatcaagctcagcattttgtcttttttttgttttggtttaaacaactttgggtttacttgtaagagtatttcagtggaggtcatgatgatgcttaatctcaacataatgactcagtttaccattgtaaactctttgtaggatgtcactgattttatcagtcatttgttcatgcagctgggaactgtggggatatatgatttgccacatctgaggaacaaactggttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgattt

SEQ ID NO: 312451 - DNA, 1017 bp, Homo sapiens
atcccctacactgttgtcctactgcagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaaggatgtcactgattttatcagtcatttgttcatgcagctgggaactgtggggatatatgatttgccacatctgaggaacaaactggagggtgactggagagattatggttttcttatgaatttcttgcttgagcctgcttgtctgctgtttctaagttgtctgcactattttatttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgattt

SEQ ID NO: 312452 - DNA, 529 bp, Homo sapiens
  misc_feature (37)..(37): n is a, c, g, or t
gttagtattgatttggttttcaaataaaaaacaacanaaaggcttaggggaactgatctacctgcttggttcatccgctgggaactgtggggatatatgatttgccacatctgaggaacaaactggttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgattt

SEQ ID NO: 312453 - DNA, 651 bp, Homo sapiens
atcccctacactgttgtcctactgcagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaacttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 312454 - DNA, 486 bp, Homo sapiens
acttaaagaaactgatatgattaaatattaagagacaatatgatccttgttggcttgtaaccctagtttttattgtcttgtagttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgattt

SEQ ID NO: 312455 - DNA, 891 bp, Homo sapiens
tgacattgtgccactgcatttcagcctgggtgacagagtgagactctgtctcaaaaacaaaacaaacagaaacaagaactctatgttgagaaatccatactagagggtttaatttctcactttgtgtgctagtgattaataaatttcaagcttatcacacagccagaaatgtcacctgtgtttctacaataaaagatttgggaatattgtgacattttttcactgagccttctgggttcattattaagatataacaattttagaagacttattgagataggtatactttttaaaatttggattcaatatatcaagctcagcattttgtcttttttttgttttggtttaaacaactttgggtttacttgtaagagtatttcagtggaggtcatgatgatgcttaatctcaacataatgactcagtttaccattgtaaactctttgtaggatgtcactgattttatcagtcatttgttcatgcagctgggaactgtggggatatatgatttgccacatctgaggaacaaactggccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgattt

SEQ ID NO: 312456 - DNA, 532 bp, Homo sapiens
gacattgtgccactgcatttcagcctgggtgacagagtgagactctgtctcaaaaacaaaacaaacagaaacaagaactctatgttgagaaatccatactagagggtttaatttctcactttgtgtgctagtgattaataaatttcaagcttatcacacagccagaaatgtcacctgtgtttctacaataaaagatttgggaatattgtgacattttttcactgagccttctgggttcattattaagatataacaattttagaagacttattgagataggtatactttttaaaatttggattcaatatatcaagctcagcattttgtcttttttttgttttggtttaaacaactttgggtttacttgtaagagtatttcagtggaggaaaagtatcagaagtttagcactgagtgcctgcctaactattttatgtcttctttcatgatgatgcttaatctcaacataatgactcagtttaccattgtaaactctttgtaggatgtcactgattttatcagtcatttgttcat

SEQ ID NO: 312457 - DNA, 480 bp, Homo sapiens
tatgtgtctttttttcatcgccagcatcctgtggcagctgctactcatttgcttctatgggtatgctagaagcgagaatccgtatactaaccaacaattctcagaccccaatcctaagccctcaggaggttgtgtcttgtagccagtatgctcaaggtaagtgttgcatttcagacaccatttatgagctatttacctgtgtgcagctggctgttgttggcaaaggcaaaaggatgatgcagtagagagagcgcagtgtctatagtcagaaaatctgagtgcaagtctggccctatcacttattaatggatgattgctcatggaatttactgtaccatccagcaaaatgtcaatagttactatatattgagtgagctctgcttgttacatatattgcctaacaatgctcaaaactctgagaagtagtaagtataatccctatttatgggcggggaacaggaactaagaaatttttctaat

SEQ ID NO: 312458 - DNA, 346 bp, Homo sapiens
ccattgaaaaatttctaactttcttattaaaagcaagcttcctcacttcctgatggcttatgcaaattaatgcctatttattcatcagagggtgactggagagattatggttttcttatgaatttcttgcttgagcctgcttgtctgctgtttctaagttgtctgcactattttatgtgagtaattttctactttattatgttctgttttcacatgtcaaatcagctctcccaagaatgctacttgtaacctaagtagacgtgaaccgaaaagggtaaagacccagctaaaaaaaaggttgactcaagttcagttcacattcgtaaagtagttaggctgccttagg

SEQ ID NO: 312459 - DNA, 1929 bp, Homo sapiens
atcccctacactgttgtcctactgcagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 312460 - DNA, 1722 bp, Homo sapiens
atcccctacactgttgtcctactgcagctatttcaaggcgcgcgcctcgtggtggactcaccgctagcccgcagcgctcggcttcctggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgca

SEQ ID NO: 312461 - DNA, 2393 bp, Homo sapiens
atcccctacactgttgtcctactgcagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaacatgctatattttttaaaatcaatgtgaaaacatagacttatttttaaattgtaccaatcacaagaaaataatggcaataattatcaaaacttttaaaatagatgctcatatttttaaaataaagttttaaaaataactgcaaaaaaaaaaaaaaaaaaaaaaaaaaaaaaaacaaaaaaataaaaaaaaaaaaaaaaaaaaaaaaaaaaaaaaaaaaaaaaaaaaaaaaataaaaaaaaaaggggaataaaaaaaaaaaaaaaaactaaaaaacttttgggcccctctggcccatcgattttttaaatttggacaattttttttgtggggcccaaatttgggcctctttgggcaattcccccttatgggggtgggtataaatataagtgcccgtttttaaaaccctggtttgggaaaaacctctgggttccccaattaaatcgctttgaaaaaaatcccttttccgcagtggggaatttcggaaagggcccccccagaggccttttcaaaatgtgcaacccttatgggaaatgaaaattttggggttaatttttgtaaaaatcccggttttttgtaacccttttttttaaccaagagcgcgttgt

SEQ ID NO: 312462 - DNA, 1827 bp, Homo sapiens
atcccctacactgttgtcctactgcagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggggtgagaatggctacttccggatccgcagaggaactgatgagtgtgcaattgagagcatagcagtggcagccacaccaattcctaaattgtagggtatgccttccagtatttcataatgatctgcatcagttgtaaaggggaattggtatattcacagactgtagactttcagcagcaatctcagaagcttacaaatagatttccatgaagatatttgtcttcagaattaaaactgcccttaattttaatatacctttcaatcggccactggccatttttttctaagtattcaattaagtgggaattttctggaagatggtcagctatgaagtaatagagtttgcttaatcatttgtaattcaaatgaaacttctaaactaggggtaccagctcgactctatcta

SEQ ID NO: 312463 - DNA, 1650 bp, Homo sapiens
  misc_feature (1638)..(1638): n is a, c, g, or t
atcccctacactgttgtcctactgcagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagtataaagaagagggcagcaaggtgaccacttactgcaacgagacaatgactgggtgggtgcatgatgtgttgggccggaactgggcttgtttcaccggaaagaaggtgggaactgcctctgagaatgtgtatgtcaacacagcacaccttaagaattctcaggaaaagtattctaataggctctacaagtatgatcacaactttgtgaaagctatcaatgccattcagaagtcttggactgcaactacatacatggaatatgagactcttaccctgggagatatgattaggagaagtggtggccacagtcgaaaaatcccaaggcccaaacctgcaccactgactgctgaaatacagcaaaagattttgcatttgccaacatcttgggactggagaaatgttcatggtatcaattttgtcagtcctgttcgaaaccaagcatcctgtggcagctgctactcatttgcttctatgggtatgctagaagcgagaatccgtatactaaccaacaattctcagaccccaatcctaagccctcaggaggttgtgtcttgtagccagtatgctcaaggctgtgaaggcggcttcccataccttattgcaggaaagtacgcccaagattttgggctggtggaagaagcttgcttcccctacacaggcactgattctccatgcaaaatgaaggaagactgctttcgttattactcctctgagtaccactatgtaggaggtttctatggaggctgcaatgaagccctgatgaagcttgagttggtccatcatgggcccatggcagttgcttttgaagtatatgatgacttcctccactacaaaaaggggatctaccaccacactggtctaagagaccctttcaacccctttgagctgactaatcatgctgttctgcttgtgggctatggcactgactcagcctctgggatggattactggattgttaaaaacagctggggcaccggctggtggtaatcgatcgagaagactgttagtgtgcatgaagctgcagtggcggccaccaatctaatggggtttctcagattcaaagatgctccggaagggatgggttccagagggattgggcttgaataaaaattgaagtttttaaaaaaggataaaaaaaaggagggttataaaagaggagaaggaaaaggtttatttaagaagtctcaataatttaangggcgtttattg

SEQ ID NO: 312464 - DNA, 870 bp, Homo sapiens
atcccctacactgttgtcctactgcagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatggcttggcaattctggccatttcaccatcatttacaaccaaggctttgagattgtgttgaatgactacaagtggtttgccttttttaaggatgtcactgattttatcagtcatttgttcatgcagctgggaactgtggggatatatgatttgccacatctgaggaacaaactggttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgattt

SEQ ID NO: 312465 - DNA, 844 bp, Homo sapiens
atcccctacactgttgtcctactgcagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggaccacaagaaaaaaaagtagtggtgtaccttcagaagctggatacagcatatgatgaccttggcaattctggccatttcaccatcatttacaaccaaggctttgagattgtgttgaatgactacaagtggtttgccttttttaagttattaaatagagcatctgttgagggactcttttaaaaccacagccatgaacagacgttggggctaagagacagagcagcctgcgacagtgtggacctacctgtagcagctagcaaaggcctctagcagctacagtcccttctggagtctttatttgcatgcaaaatgcaaaggagtcctggtgacctacctccaaggcagctgccctcctgaacactcccttggaaaacagtaaacatcattttggaatgtgaacaaccagagactacacaggagaaaggaaaaaaaaattctgaagatgcaaaatcttgggtggcttcaccgttcagttttttaataaaaggaacaatatacaacacgttgttctttttctcttttgaaatcccttctattacagtgattt

SEQ ID NO: 312466 - DNA, 323 bp, Homo sapiens
atcccctacactgttgtcctactgcagctatttcaaggcgcgcgcctcgtggtggactcaccgctagcccgcagcgctcggcttcctggtaattcttcacctcttttctcagctccctgcagcatgggtgctgggccctccttgctgctcgccgccctcctgctgcttctctccggcgacggcgccgtgcgctgcgacacacctgccaactgcacctatcttgacctgctgggcacctgggtcttccaggtgggctccagcggttcccagcgcgatgtcaactgctcggttatgggtaagccgccggctcggcagtcctccgg

SEQ ID NO: 312467 - DNA, 860 bp, Homo sapiens
gtccgagccggctggcgcaggtgacccgcagttacccgggctcggttcccacgtaatgctgggaaaccccggctgacgcgcccctcccccgcccgcagtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312468 - DNA, 3743 bp, Homo sapiens
cggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctggtgaggggcccgagggggaggagggcacagggcagctgctgtcgctgccatggcagtggccagcccctgcaggggggtgggggccggccggccagggccatgtcctgagccccctgggcgtgcctcctggaacagacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggtttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttgtttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312469 - DNA, 3629 bp, Homo sapiens
cggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctggtgaggggcccgagggggaggagggcacagggcagctgctgtcgctgccatggcagtggccagcccctgcaggggggtgggggccggccggccagggccatgtcctgagccccctgggcgtgcctcctggaacagacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggtttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttgtttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312470 - DNA, 3711 bp, Homo sapiens
cggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggtaggtggtgaccccgcccggagtctcctagggccgcctgccaaggactcctggaagacctccagaccctcaccccgtcgtggttctgtggcttctcccccaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggtttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttgtttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312471 - DNA, 3554 bp, Homo sapiens
cggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccgttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggtttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttgtttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312472 - DNA, 847 bp, Homo sapiens
  misc_feature (10)..(11): n is a, c, g, or t
ctaaaattgnnacgatacagagaagattagcatggcccctgcgcaaggatgacacgcaaattcgtgaagcgttccatatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttgtttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312473 - DNA, 1748 bp, Homo sapiens
cggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctggtgaggggcccgagggggaggagggcacagggcagctgctgtcgctgccatggcagtggccagcccctgcaggggggtgggggccggccggccagggccatgtcctgagccccctgggcgtgcctcctggaacagacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcagggggtgagtaccagccgcacgggcggcaggagggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312474 - DNA, 1205 bp, Homo sapiens
cggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctggtgaggggcccgagggggaggagggcacagggcagctgctgtcgctgccatggcagtggccagcccctgcaggggggtgggggccggccggccagggccatgtcctgagccccctgggcgtgcctcctggaacagacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagagcactagtgtcctgccaagcactagtgtcctgccaagcactagtgtcctgccaa

SEQ ID NO: 312475 - DNA, 840 bp, Homo sapiens
cggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggtaggtggtgaccccgcccggagtctcctagggccgcctgccaaggactcctggaagacctccagaccctcaccccgtcgtggttctgtggcttctcccccaggcttcccgcatctgctcatacagcaggtagaagtggtcttcgtcgctcgaactcctcgctcgtatctta

SEQ ID NO: 312476 - DNA, 474 bp, Homo sapiens
tgaggcgaagtctcactctgtcaccaggatgctggagtgcaatggcgcgatctcagctccctgcaacctccacctcccgggttcaagtgattctcctgcctcagcctcacaagtagttgggattacaggcgtgtaccaccacacccagctaatttttatattttcagtagagacagggttttgccatgttggccaggatggtctcaatctcctgacctcatgatccacccgccttggcctcccaaagtgctgggatgacaggcgtgagccctgctttctagagttgcagggcgttaagtgtggtgaattccagccgtggcagtggagtttctggccccttctcgactatgagcgtcccaccaacccaggtgctgtgtcctttcgcctgtttcagatcattgagaagcagccaggccacattcggagcagggttttcagggaggtggagatgctgtaccagtgccagggacacag

SEQ ID NO: 312477 - DNA, 1582 bp, Homo sapiens
cggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312478 - DNA, 3608 bp, Homo sapiens
cggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggtttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttgtttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312479 - DNA, 3598 bp, Homo sapiens
  misc_feature (36)..(36): n is a, c, g, or t
  misc_feature (102)..(102): n is a, c, g, or t
aggcaattttttggcgacactattaatgaaaaccgnttggtgttaaaagcggtcgcgatcggatttgattgctgcagtgtcagcgcctgtgagtgctgaggngagaggcaaggcagtgtgtgtgcatgcagtggcagcctcaggtggtgggcggacgcaggccatgtcctgagccccctgggcgtgcctcctggaacagacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggtttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttgtttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312480 - DNA, 3187 bp, Homo sapiens
gctctagtggatcccccaagccaagcattcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggtttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttgtttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312481 - DNA, 3213 bp, Homo sapiens
ggacgcgtgggtcgacccacgcgtccggggaggtggagatgctgtaccagtgccaggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcagggggtgagtaccagccgcacgggcggcaggagggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggtttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccgtccttgtccttagagctgagcccagaccccggggtctggccgaatcctcacccccagggcagtgtttttggtctgccaccttcaggaaaacggctgcggcctcggcctcccttcgggcacccaggaatgcgggggtctgctcagtccccccaccctccatgctccaacccccgggggctgcggagcctgctgccccctccccgcgggtggggacgttctatgcaatacagggttccactttagaagtgcgcgcggctagggtcaccgcccgcccttcccggcgcagcccccgagctccacagctggggcagcccctctggcttctaaatccgcggtcgggattcttcctcctgtttagttttttagtttttccttaaaaaaaaacaacacatcgatggactttgcttccctgttcttgaagaatacttgaatgtcggggggcctgggggtgggggcctcggagaccgtctgcctggccctgctgcccctcctgaatctcgtatgatggtcacagtccggtggccgtgggggtgctctgccttccctggtccccactgcccatatctgtggactgccccttccaaagacccctggggggggtggggcattccgcccacccctttcccccatcacttctcgcctgtcagtgattccatgtttcgtaacgggggattctctgcctttttgtatcaaagaacaagcaaatggacccccgcccgctgcaggcgcccatagccatcgggtctctaaagctgagtggctagcagcgtttgtttgtttgtttgtttttttttttctgaaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312482 - DNA, 2660 bp, Homo sapiens
cggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacataggtcacccgtcccccaatcaaatctaaaggttttttaagctatcgccagccggtgtccagcgggctgcccctcctctgcctggattcccaggcactaagctcagctgaggggggtgttttatagaaggtttttgcttttgggtttttttttcctgtttccacccctccccgttattttttcctttggatggttaaaagcattgcaggcacccgggaaggtgagcagagggtaggtgggtgggcttgtcccctccccggtcccccgccctgctcacctctactatgaaggtgcccccaggtcacctgtgctgcccgccatctgcccacgtggcttgcagtgactcaggagagcaggcccacagcgtttgccatcttgcagagctggggaggggcacaggaccctgccctcgtgttccctcccagcccgcagtatttcagggacaggctcttcccctctatccctcaccctgagagcacccctggtggcttggttggggaagggaggggctgcctgtctctggaggtgtcaggcaggcaggtggcaggcagctcacccacccaccccatgggatcccccagcccttcacccgcgcctgccttgtccccatgatagttgacaatcggggcttcctgcaaggcccgtctgtctgtccaggactcctggtggccagattcggcctccgaccttgaccttaaactgcagctgaccccaggggctcgccgctgcccctcccctccacaccaaggcctgagacagcaggagccccgcctggcccgaagccgtttccaccgcagcaggcagaggggctggacaggcactgtcagccaatgtggggggtcctgaagacacccccttggggcacccgagtgccccttctcagggctcagtctgaccgtagccacgtcctgcctcgcgccgcccctcgggcctgacctggaagctccgtcagctccacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312483 - DNA, 1707 bp, Homo sapiens
cggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggaacagctgtgccaaagacctcacgtccttcgcggctgaggccattgccatgaaccggcagctggcccagcacgacgaggacctggctgaggaggaggccgcggggcagggccagcccgtcctggtccgagctacctcacgctgcctgcagctgtctccaccctcccagtccaagctggcgcagcggcggcaaagggccagtctgtcctcggccccagtggtcctggtgggagaccacgcctgaccctcccatctcccctctgtacatagacggccatgtgttaatgttacgatgtttttaaaagacaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 312484 - DNA, 460 bp, Homo sapiens
ccggccgcccgccctcgggcctccccccgggccctcggtcccctcccccgctggcggggcccggacagaagatggtgcagaagaaaccagccgaacttcagggtttccaccgttcgttcaaggtgaggcccggggtcggtttgggggcgctccgggctggaccaccggaatggccggcgtggggggcgcggggcccgcccctaagatcggctcccggggctcgtgcctggcccccgccctacacccggggctgcccgggccggccgtgcgctgaagcggggtcggtgtgcgaggatgggggttcagcaggccacagtcctctctccagccatggccgccgggtccttcctccaggacccccaagtgaggctgggagcaggagccccctccgggtcagggcaccaggctgtgtgtcccctgcaagcccccgccgggtatgttctggggggtcagcaggctg

SEQ ID NO: 312485 - DNA, 2312 bp, Homo sapiens
cgcgctggagaggcgcggggtcaagacgtccggcctcgggggcccgggctgggccgccgagtcccctgggcggcgctgagcgggcgggaggcgggggcccgcggctcggggcaaccgaggccgggtcgcgggatcggccgccatcgccgccgccgctgcactgggagcccgcggggatggagcgggaggcgttgccgtggggcctcgagccccaggatgtgcagagttctgacgaaatgaggagccccgaagggtacctcagaggcaacatgagtgagaatgaggaagaggaaatttctcagcaagaaggcagtggggactatgaagtcgaagagataccatttgggcttgaaccccagagccctgggtttgagccacaaagcccagagtttgaaccccaaagccccagatttgagcctgaaagcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccaaattccaggaaggtgcggagatgcttctgaaccccgacgaaaagagtcctttgaatatctccgtaggagttcaccccctggactccttcactcaggggtttggggagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgcggcatctgcgggaagagcttcgggcggggctccaccctgatccagcaccagcgcatccacaccggtgagaagccctacaaatgtgaggtctgcagcaaggccttctcccagagctctgacctcatcaaacaccagcgcacccacactggcgagcggccctacaaatgtccccgttgcggcaaggccttcgccgacagctcttacctgcttcgccaccagcgcactcactctggccagaagccctacaagtgcccacattgtggcaaggccttcggcgacagctcctacctcctgcgacaccagcgcacccacagccacgagcggccctacagctgcaccgagtgcggcaagtgctatagccagaactcgtccctgcgcagccatcagagggtgcacaccggtcagaggcccttcagctgtggcatctgcggcaagagcttctcccagcggtcggcccttatcccccatgcccgcagccacgcccgggagaagcccttcaagtgccctgagtgcggcaagcgctttggccagagctcggtgctggccatccacgcccgcacccacctgccaggccgcacctacagctgccccgactgcggcaagaccttcaatcgctcctccactctcatccagcaccagcgctcccacacgggcgagcggccctacaggtgcgccgtgtgcggcaagggcttctgccgctcctccacgcttctgcagcatcaccgggtccacagtggcgagcggccttacaagtgcgatgactgcggaaaggccttctcccagagctccgacctcatccgccaccagcggacccacgcggcgggccggcgctgacctggggccccagcaggggtgggaggtgtgggcagaagataaggggccagggagctagaggaacctttagggaggatagtggagaagccgcaggagaatggaggagctgaggatgctggaagaagagaaccagggtggaggaagtgacatgccctggagacttgtgggaagtgggttggagggaggccaggccggcagcgggaggccctgggagaaatggagagaggtcagcggagggctggcctcagccgcggctccttggtgggtgcctggcttggcaactgctagagcagggaggggggagggcaggggattacctaattagagtgggttagcttagattggtagctgctgaaactctcgttgagtcaggagcgggtaaaaggtaggtggggtggggagtggggccccggggtggggcctgggcctctgcgtgcaaaccccagcctccctcttcttcctcaggctttggagcccctgagtttgagttcaataaaaactttatgtggtaaa

SEQ ID NO: 312486 - DNA, 2236 bp, Homo sapiens
cgcgctggagaggcgcggggtcaagacgtccggcctcgggggcccgggctgggccgccgagtcccctgggcggcgctgagcgggcgggaggcgggggcccgcggctcggggcaaccgaggccgggtcgcgggatcggccgccatcgccgccgccgctgcactgggagcccgcggggatggagcgggaggcgttgccgtggggcctcgagccccaggatgtgcagagttctgacgaaatgaggagccccgaagggtacctcagaggcaacatgagtgagaatgaggaagaggaaatttctcagcaagaaggcagtggggactatgaagtcgaagagataccatttgggcttgaaccccagagccctgggtttgagccacaaagcccagagtttgaaccccaaagccccagatttgagcctgaaagcccggggtttgagtcccgaagccctgggcttgtgcccccaagccctgagtttgcacccagaagccctgaatcagattctcagagccctgagtttgaatcccagagccctaggtatgaaccccaaagccctggctatgaacctcggagccccgggtatgaaccccggagccctggctatgaatctgagagctctagatatgaatcccagaacactgagctcaaaacccaaagcccagaatttgaagctcaaagttccaaattccaggaaggtgcggagatgcttctgaaccccgacgaaaagagtcctttgaatatctccgtaggagttcaccccctggactccttcactcaggggtttggggagcagcccacaggggacctgcccatagggccaccttttgagatgcccacaggggccctgctgtctacaccgcagtttgagatgcttcagaatcccctgggtctcacaggagcccttcgaggtccaggtcggcggggtggccgggccaggggtgggcagggccctcggcctaacatctgcggcatctgcgggaagagcttcgggcggggctccaccctgatccagcaccagcgcatccacaccggtgagaagccctacaaatgtgaggtctgcagcaaggccttctcccagagctctgacctcatcaaacaccagcgcacccacactggcgagcggccctacaaatgtccccgttgcggcaaggccttcgccgacagctcttacctgcttcgccaccagcgcactcactctggccagaagccctacaagtgcccacattgtggcaaggccttcggcgacagctcctacctcctgcgacaccagcgcacccacagccacgagcggccctacagctgcaccgagtgcggcaagtgctatagccagaactcgtccctgcgcagccatcagagggtgcacaccggtcagaggcccttcagctgtggcatctgcggcaagagcttctcccagcggtcggcccttatcccccatgcccgcagccacgcccgggagaagcccttcaagtgccctgagtgcggcaagcgctttggccagagctcggtgctggccatccacgcccgcacccacctgccaggccgcacctacagctgccccgactgcggcaagaccttcaatcgctcctccactctcatccagcaccagcgctcccacacgggcgagcggccctacaggtgcgccgtgtgcggcaagggcttctgccgctcctccacgcttctgcagcatcaccgggtccacagtggcgagcggccttacaagtgcgatgactgcggaaaggccttctcccagagctccgacctcatccgccaccagcggacccacgcggcgggccggcgctgacctggggccccagcaggggtgggaggtgtgggcagaagataaggggccagggagctagaggaacctttagggaggatagtggagaagccgcaggagaatggaggagctgaggatgctggaagaagagaaccagggtggaggaagtgacatgccctggagacttgtgggaagtgggttggagggaggccaggccggcagcgggaggccctgggagaaatggagagaggtcagcggagggctggcctcagccgcggctccttggtgggtgcctggcttggcaactgctagagcagggaggggggagggcaggggattacctaattagatggggccccggggtggggcctgggcctctgcgtgcaaaccccagcctccctcttcttcctcaggctttggagcccctgagtttgagttcaataaaaactttatgtggtaaa
